United States Patent 11,098,302 (IDENTIFICATION OF POLYNUCLEOTIDES ASSOCIATED WITH A SAMPLE) - sequence listing, part 143

SEQ ID NO: 533351 - DNA, 513 bp, Homo sapiens
  misc_feature: HEFZJCU01C91JJ.11.71.G05.1.454.heavy.3.raw
cgagagataccacgaccggtgctcgatttagtgtcgtcgcaagagagagggggggggagaggagcccaacactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattacgtgtgacgaaagtatttactatagaggtgacgtacggggggtcg

SEQ ID NO: 533352 - DNA, 491 bp, Homo sapiens
  misc_feature: HEFZJCU01B03K8.49.75.G09.1.454.heavy.3.raw
agtcgagagacacgaccggtgctcgatttagtatagacatcagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgcttcatcatctccagagaacaactccgagaacacgactgtaatctgcaaatgaacaggctgagtagttggaagacacggctggtatattactgtgcgtaacttatcgaac

SEQ ID NO: 533353 - DNA, 509 bp, Homo sapiens
  misc_feature: HEFZJCU01CCHRK.11.19.B08.1.454.heavy.3.raw
  modified_base (502)..(502): a, c, t, g, unknown or other
cgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccagggaaggggctgggagtgggtttcatacattttctagtaattctggtaccatacactatgcagtctctgtgaagggccgattcaccatctccagagacaacgccaggaactcactttatctgcaaatgagcagcctgagagtcgagggacacggggtatttattactgtgcgagagatagtctgtctatgcttccggggancgtaact

SEQ ID NO: 533354 - DNA, 383 bp, Homo sapiens
  misc_feature: HEFZJCU01BN41L.9.78.H01.1.454.heavy.3.raw
  modified_base (347)..(347): a, c, t, g, unknown or other
tgatacgtctcacgaccggtgctcgatttagtgtgagtagtttgggtttgggtgccgaagttgctggaggtcacggtcaccacgctgctgagggagtaggtccctgagactctcctgtgcagcctctggattcgcctctggattgacgttcagtgactactacatgacctgggtccgccaggctccagggaagggctggagtgggtttcatacatttatcctagttgggtgataccatatactacgcagactctgtgtaaggccgtattcaccattctccagggacaacgccaagaactcactgactttgcaaatgaacaccctgcgagccgaggacacggccgtanatttactggtgacgagaactaacccgtttcgccctt

SEQ ID NO: 533355 - DNA, 507 bp, Homo sapiens
  misc_feature: HEFZJCU01BPVCN.48.41.D08.1.454.heavy.3.raw
agtatacatacacgaccggtgctcgatttagtcacgcgagaaagggaaaggggggggaggcttggtacagcctggcaggtccctgaaactctcctgtgtagcctctggattcaggttgggcgattatgccatggcaatgggtccggcaaggtccagggaagggcctggagtgggtctcaggcatcgattggaaaagcgagaagattgactatgcggagtctgtgaaggggcgattcatcatctccagagacaacgccaagaactccctgtatttgcagatgaacaatctgagacctgacgacacggccttgtattattgtgcaaaagttgtggagtcacagtctctggactacggtatggacgtctggggccaagggaccacggtcacagtctcctcagcctccaccaagggcccatcggtcttcccctggcaccctcctccaagagcacctctgggggcacagcggccctgggctgcctggtcaaggactacttcctatgtatact

SEQ ID NO: 533356 - DNA, 480 bp, Homo sapiens
  misc_feature: HEFZJCU01CH1MM.51.76.G10.1.454.heavy.3.raw
cgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcactgggtccgccaggctccaggcgaaggggctgggagtgggtggcattttatatcagatgatggcagtaataaagagtatgcagtctccgtgaagggccgattcaccatctccagagacaattcccagaacacactgtatctgcaaatgaacagattgagagctgaggacacggctgtgttatttctgtgcgaaacgctat

SEQ ID NO: 533357 - DNA, 506 bp, Homo sapiens
  misc_feature: HEFZJCU01AMO0Z.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacctaacactggtgtcacagtgtcttcacccatcctccgggacagacttaccatgaccacgaactcctccataaaccacagcctacatggagttgaggagcctgacatctgacgacacggccgtctattactgtgcgagagtcccacgatccggtgagcctacggcagcggcctttgacctttcgtc

SEQ ID NO: 533358 - DNA, 534 bp, Homo sapiens
  misc_feature: HEFZJCU01BVSOJ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgatttcaccatctccagagacaattacaagaacaccctttatctgcaaatagacagcctgagaccagacgacacggctgtctattattgcgcgagagagacacacgaacctactggccaatactatgggggcttggttctgggggccaggggaccctgggtcagtcgtctccccagcctccaccaagggcccatcggtcttccccctggccgccctcg

SEQ ID NO: 533359 - DNA, 518 bp, Homo sapiens
  misc_feature: HEFZJCU01B802B.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggccaccctcctccaagagcacctctgggggcacagcggccctgggctgcctggtcaggactacttccgagtagtac

SEQ ID NO: 533360 - DNA, 553 bp, Homo sapiens
  misc_feature: HEFZJCU01BVOEK.48.40.D07.1.454.heavy.3.raw
  modified_base (407)..(407): a, c, t, g, unknown or other
agtatacatacacgaccggtgctcgatttagtgatagagcgtaacaacagagagctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccaggaaggggctggagtgggtctcaacgtgaacgttgatggcgggatcacaaaatacgcggactccgtgaaaggccgcttcaccgtctccagagacaacggcgagaatactctgtatttttgcagatgagaaatctgagaggcgaggacaccgcgctttattattgtanaacgtcgttttacttttctaattggtggctcttacgaacgacatgactattgggggtcggggaaccctggtcaccgtctcctcagcctccaccaagggcccatcggtcttccccctggccaccctcccttccaagtagcacctctc

SEQ ID NO: 533361 - DNA, 493 bp, Homo sapiens
  misc_feature: HEFZJCU01B6DB7.13.74.G08.1.454.heavy.3.raw
  modified_base (460)..(460): a, c, t, g, unknown or other
  modified_base (491)..(491): a, c, t, g, unknown or other
tcacgtactacacgaccggtgctcgatttagtagctctatcaggggagctctgggagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggaggcgtggtccagcctggggaatccctgacactgtcttgtgtagcctctggattcagcttcagaacctatggcatgcactggtccgccaggccccaggcaaggggctggagtggctgactcttttatcatatgatggaagtcaaaaattctatgcagactccgtgaagggccgattcaccgtctccagggacaactccaagaacaccttatatctgcagatgaacagcctgagaggtgacgactcggctgtntacttctgtgcgacaaacatgatggtttggngt

SEQ ID NO: 533362 - DNA, 506 bp, Homo sapiens; identical to SEQ ID NO: 451832
  misc_feature: HEFZJCU01DG0A8.17.25.C03.1.454.heavy.3.raw

SEQ ID NO: 533363 - DNA, 390 bp, Homo sapiens; identical to SEQ ID NO: 448683
  misc_feature: HEFZJCU01BA67E.11.25.C03.1.454.heavy.3.raw

SEQ ID NO: 533364 - DNA, 503 bp, Homo sapiens
  misc_feature: HEFZJCU01CIDZV.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaagggggactgacatctgacgacacggccatgtattattgtgcgagagaaatgttagtactgtcttggtcctggggcccgggaccgggtc

SEQ ID NO: 533365 - DNA, 528 bp, Homo sapiens
  misc_feature: HEFZJCU01CHYVD.8.34.D01.1.454.heavy.3.raw
ctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcacctttcagtaactacggcatgcactgggtccgccaagctccaggcaagggattggagtgggtggcagttgtttcatctgagggcagtgttcaatggtatgcagactccgtgaagggccgattcacatctccagagacaattccaggaacacaatgtatttgagctgaacagcctaagtcctgaggacgacgggcgtatactactgtacgaagggaaggggggaaccgacggcggggacgttcaagtactcctttgtac

SEQ ID NO: 533366 - DNA, 424 bp, Homo sapiens
  misc_feature: HEFZJCU01AZ38J.11.22.B11.1.454.heavy.3.raw
cgagagataccacgaccggtgctcgatttagacgacagctcaagggaaggggctagagtggattggggaaatcaatgatagtggaagcaccaactacaacccgtccctcaagagccgagtcaccatatcagtagacacgtccaagaaccagttctccctgaagttgacctccgtgaccgccgcggacacggctgtgtattattgtgcgagaggggttaatggcgccttaatgatgacccgggcgcggcccggtgtacaatggagggagttacatggacgtctggggcaaagggaccacagtcatcgtctccgcagcttccaccaagggcccatcggtcttccccctggcgccctgctccaggagcacctctgggggcacagcggccctgggctgcctggtcaaggactacttccgtatctctcg

SEQ ID NO: 533367 - DNA, 486 bp, Homo sapiens
  misc_feature: HEFZJCU01B8N81.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctggggaaggacatatttcatgtccaacacgtggaatacaaattatgcaccatctgttgagagtcgaactgacaatcaacgtagacacatcgaagaacctagttctccctgcagctgacctctgtgactcccgaggacacgggtgtatattactgtagaagaggcccccatacg

SEQ ID NO: 533368 - DNA, 533 bp, Homo sapiens
  misc_feature: HEFZJCU01EFKWI.7.78.H01.1.454.heavy.3.raw
  modified_base (486)..(486): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttacaacctgacgacactgtccgttttatttttgtacgtagagcgtcgtctgtcagtggaatgacnctggggcagggaacctggtcaccgtctcctcacgcctccaccaacgg

SEQ ID NO: 533369 - DNA, 506 bp, Homo sapiens
  misc_feature: HEFZJCU01D782W.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgaggccctatcctacagtgaccactccacgctgtcgacctcgtggggaccac

SEQ ID NO: 533370 - DNA, 519 bp, Homo sapiens
  misc_feature: HEFZJCU01CYO3P.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttccccctggcaccctcctccaagagcacctctcgggggcacacgcggccctggctgcctggtcaggactacttccagacgtatcga

SEQ ID NO: 533371 - DNA, 392 bp, Homo sapiens; identical to SEQ ID NO: 444682
  misc_feature: HEFZJCU01DU08H.16.70.G04.1.454.heavy.3.raw

SEQ ID NO: 533372 - DNA, 364 bp, Homo sapiens
  misc_feature: HEFZJCU01D38DX.52.78.H01.1.454.heavy.3.raw
cgcagtacgacacgaccggtgctcgatttagtgtgagtagtttgggtttggggatggttttctcgatgaggtctcggagaggagccttagccctggactcccaaggcctttccacttggtgatcagcactgagcacagaggactcacccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagca

SEQ ID NO: 533373 - DNA, 535 bp, Homo sapiens
  misc_feature: HEFZJCU01DJ199.17.28.C06.1.454.heavy.3.raw
  modified_base (448)..(448): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtggccaacataaagcaagatggaactgccgagttttacgtggactctgtgaagggccgtttcaccatctcagagacaacgccaagaattcactgtatctacaactgaacagcctgagngtcgcagacacggccgtgtattactgtagcgagatgtggaaaaagtagtaggctgtgtttattgggggtccaggggagccctggtcc

SEQ ID NO: 533374 - DNA, 540 bp, Homo sapiens
  misc_feature: HEFZJCU01D323L.17.28.C06.1.454.heavy.3.raw
  modified_base (527)..(527): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggtccgtttcaccatctccagagacaacgccaagaattcactgtatctacaactgaacagcctgagagtcgcagacgacggccgtgtattactgtgcgagatggtagaaaaagtatggctgtgtttagttggggccaggggancccgtgtctaccg

SEQ ID NO: 533375 - DNA, 333 bp, Homo sapiens
  misc_feature: HEFZJCU01C2R54.40.81.H04.1.454.heavy.3.raw
tctagcgactcacgaccggtgctcgatttagtagtgtagattcgcgggtgtccttgggttttggggggaagaggaagactgacggtcctgccacagctggtgcagtctgtggctgaggtgaagaagcctggggcctcggtgaaggtctcctgcaagatttctggaaacaccctgagcaactactacatacactggatgcggcaggcccctggacagggggtttgagtggatggggtggatcaaccctaccagaggtggcacaaagtatcgacagaactttcagggcagggtcaccatgacctgggacgcgtcatcagcacagtctacatggat

SEQ ID NO: 533376 - DNA, 510 bp, Homo sapiens
  misc_feature: HEFZJCU01B9827.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaaggggactgacatctgacgacacggccatgtattattgtgcgagagaaatgttaggtactgtctttggggtccctggggcccgggaacccggggtc

SEQ ID NO: 533377 - DNA, 497 bp, Homo sapiens
  misc_feature: HEFZJCU01B9Z7A.51.53.E09.1.454.heavy.3.raw
cgatcgtatacacgaccggtgctcgatttagagagagtgtgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggtccttgtattactgcgcaaaagccaaggcaacg

SEQ ID NO: 533378 - DNA, 503 bp, Homo sapiens
  misc_feature: HEFZJCU01BI0J8.11.27.C05.1.454.heavy.3.raw
  modified_base (490)..(490): a, c, t, g, unknown or other
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgttgcgagaggagcttattatntaggaaccccgat

SEQ ID NO: 533379 - DNA, 504 bp, Homo sapiens
  misc_feature: HEFZJCU01CRFJL.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgattatgtgggccgagggacaagtggtcaccgt

SEQ ID NO: 533380 - DNA, 519 bp, Homo sapiens
  misc_feature: HEFZJCU01CXNRL.13.87.H10.1.454.heavy.3.raw
tcacgtactacacgaccggtgctcgatttagcagtactgcgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactggggtccggcaagctccagggaaggcctggagtgggtctcaggtattagttggaatagtggtagcataggctatgcggactctgtgaaggccgattcaccatctccagagacaacgccaagaactccctgtatctgcaaatgaacagcctgagagctgaggaccacgggccttgtattattgtgcaaaagactccctaaccccttaccgtatttttggtagtggtttacg

SEQ ID NO: 533381 - DNA, 405 bp, Homo sapiens
  misc_feature: HEFZJCU01BX75C.3.17.B06.1.454.heavy.3.raw
agacgcactccacgaccggtgctcgatttagtcgatagtgaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtattcgcggtgggtctactgggccagggaaccctggtcaccgtctcctcagcctccaccaagggcccatcggtcttccccctggcgccctgctccaggagcacctccgacgagcacagcggccctgggctgcctggtcaaggctaacttccgagtgcgtct

SEQ ID NO: 533382 - DNA, 516 bp, Homo sapiens
  misc_feature: HEFZJCU01BIWLP.48.35.D02.1.454.heavy.3.raw
  modified_base (436)..(436): a, c, t, g, unknown or other
agtatacatacacgaccggtgctcgatttagcacacgatagttgggtttgggggctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagcccccggaagggactggaatggattgggagtatctattatacagggagcacctactacaacccgtccctcaagagtcgagtcaccatcctccgcagacacgtccaagaaccagttctccctgaggctgagctctgtgaccgccgcagacacggctgtctattactgtncgagagtgggtcgtggcagtgcttggacgtggctctcagttgttccgacccgtggggccagggactaccgtggtctaccg

SEQ ID NO: 533383 - DNA, 516 bp, Homo sapiens
  misc_feature: HEFZJCU01CIECH.12.1.A01.1.454.heavy.3.raw
  modified_base (459)..(459): a, c, t, g, unknown or other
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagttgggatcacctactacctaacccgtccctcaagagtcgagtcaccatatccgtcgacacgtccaagaaccagttctccctgaagctgagctctgtgaccgccgcagacacggctgtgtattactgtgcgagacagccaagacagtntttggagtggttactgttggactctttgacttacgtggggccaggggaccctagggt

SEQ ID NO: 533384 - DNA, 520 bp, Homo sapiens
  misc_feature: HEFZJCU01DOWTH.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgtcctttccggtccggcgggacttcgtggggccgaggggtaaccccg

SEQ ID NO: 533385 - DNA, 498 bp, Homo sapiens
  misc_feature: HEFZJCU01A9AE8.49.3.A03.1.454.heavy.3.raw
agtcgagagacacgaccggtgctcgatttagagagcgtcacagaggagaagggggcatcatccaacaaccacatcccttctctacagaagcctctgagagggaagttcttcaccatggactggacctggagggtcttctgcttgctggctgtagctccgggtgctcactcccaggtgcagttggtgcagtctggggctgaggtgaagaagtctggggcctcagtgaagatttcctgcaaggcttctggataccccttcaccatctaccacatgcactgggtgcgacaggccccgggacaagggcttgagtggatgggaataatcaaccctagtggtggtagcacaacctccgcacagaggttccagggcagagtcaccatgaccagggacacgtccacgagcacattctacatggaactgagccgcctgagatctgacgacgacggccgtgtactactgtgcgagagtcactcattactacgataggttatgggtacg

SEQ ID NO: 533386 - DNA, 499 bp, Homo sapiens
  misc_feature: HEFZJCU01D3NCE.11.81.H04.1.454.heavy.3.raw
cgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagttttgggctgagctgggttttcctcgttgctcttttaagaggtgtccagtgtcaggtgcaactggtgagtctgggggagcgtggtccagcctgggaggtccctgagactctcctgtgcagcgtctggattcaccttcaggagctatgacatgcactgggtccgccaggctccaggcaaggggcctggagtgggtggcagttatatggtatgatggaagttataaatactatggagactccgtgaagggccgattcaccatactccagagacacttccaagaacacggtgtatctgcaaatgaacagacctgagacgcggaggacgacggct

SEQ ID NO: 533387 - DNA, 493 bp, Homo sapiens
  misc_feature: HEFZJCU01DAHBV.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagctgagagctggagacgacggctgtgtattactgtgggagagatggaggtcgatattgta

SEQ ID NO: 533388 - DNA, 489 bp, Homo sapiens
  misc_feature: HEFZJCU01DGND6.48.56.F01.1.454.heavy.3.raw
agtatacatacacgaccggtgctcgatttagcagacgtctgaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcagggcagggtcaccatgaaccagggacacgtccatcagcacagcctacataggaattgagcaggctagacatctgacgacgacggccgtggttatttagttcgttgcgagagtccctacacg

SEQ ID NO: 533389 - DNA, 507 bp, Homo sapiens
  misc_feature: HEFZJCU01EZX1O.49.27.C05.1.454.heavy.3.raw
agtcgagagacacgaccggtgctcgatttagacgcgatcgaagggtttgggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctggggggggcgtggtccagcctgggaggtccctgagactctcctgtgcaggctctgcatttcccttcagtaactacgctatcgattgggtccgccaggctccaggcaagggactggagtgggtcgcagttatttcagctgatggagcaataagtattacggagattctgcgagggggcccgattcaccatatccagagacaactcccaagatatgatatatctgcaaatgaacagcctgagacctgaggacacggctatgtattattagtgcgtcgaggggggcaggtgccgtggcctac

SEQ ID NO: 533390 - DNA, 530 bp, Homo sapiens
  misc_feature: HEFZJCU01D7TS1.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccgagggggacctttggggttcgaccccgtggggccagggaaccctggtcaccgtctcctcagcctccaccaacgggcccatcggtccttccccctggccaccctcctccaagacgcacctcgtggggcacagcc

SEQ ID NO: 533391 - DNA, 520 bp, Homo sapiens
  misc_feature: HEFZJCU01D2QH5.13.36.D03.1.454.heavy.3.raw
tcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtgggttcttcagtggttactactggagctggatccgccagtccccagggaaggggctggagtggattggggaaatcaatcatagtggaagcaccaactacaacccgtccctcgagagccgagtcaccatgtcagtagacacgtccaagaaccagttctccctgagggtgagctctgtgaccgccgcggacacggctgtgtacttctgtgcgagaggctaagtttttggactcgtcattcttccctttagacttcgtggggccagggaaccctagtccaccggtt

SEQ ID NO: 533392 - DNA, 517 bp, Homo sapiens
  misc_feature: HEFZJCU01C1MST.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgtggagtcagggaactctggtcaccgtctcctcagcctccaccaagggcccatcggtcttcccctggcgccctgctccaggagcacctccgagagcacacgcggcccgtcgggctcg

SEQ ID NO: 533393 - DNA, 562 bp, Homo sapiens
  misc_feature: HEFZJCU01C5ID6.4.1.A01.1.454.heavy.3.raw
agcactgtagcacgaccggtgctcgatttagacgtctcatcaggggtcccaacaaccacatccctcctcagaagcccccagagcacaacacctcaccatggactggacctggaggatcctcttttttggttggcagcagccacaggtgtccactcccaggtccaacttgtgcagtctgaggctgaggtgaagacgccaggggcctcagtcaagatttcctgtaaggcctctggatatacgttcattaactatgctatccattgggtgcgccaggcccccggacaaaacctgacgtggatgggttggatcaatggtgaaactggaaaaaccaaatattcaccgagctttccagggcagaatgaccatcctcccgggacacatccgcgagcgcaatctatctggaactgacgccgcctgacatcttgcagactcggcagtatattttctgtgcgagaggacgggggaggagtgggttgagggggaaatttggtttaatttcccgaatttaacctacttttacggtaacccacggttcggggggtcccaaggggggtaaaccccg

SEQ ID NO: 533394 - DNA, 535 bp, Homo sapiens
  misc_feature: HEFZJCU01CJDN3.3.70.G04.1.454.heavy.3.raw
agacgcactccacgaccggtgctcgatttagtgtagtgtgaagggaaagggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccagcccggggggtccctgagactctcctgtgaagtctctgggttcactgtcagtagcaactacatgaactgggtccgccaggctccagggaaggggccggagtgggtctcaattatttatggtcgatggtagtacgtactacgcagactccgtgcagggccgattcaccatctccagagacaatttcaagaatacgttgctccttcaatgaacaacctgagaaccgaggacacggccgtatattattgtgcgagtagtacggtggtgaatgtgggtgttaacgtggggcctgggaccctggtcaccgtctcctcagt

SEQ ID NO: 533395 - DNA, 517 bp, Homo sapiens
  misc_feature: HEFZJCU01DCRCJ.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggccgaaccctaacactggtgtcacagtgtcttcacccatcctccgggacagacttaccatgaccacgaactcctccataaacacagcctacatggattggaggagcctgacatctgacgacacgggccgtcttattactgtgcgagagtcccacgacttccgggtgagccgtacgggcacggcgggccttttgaccttccgt

SEQ ID NO: 533396 - DNA, 501 bp, Homo sapiens
  misc_feature: HEFZJCU01D06PH.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactcggacttct

SEQ ID NO: 533397 - DNA, 536 bp, Homo sapiens
  misc_feature: HEFZJCU01DLF07.17.28.C06.1.454.heavy.3.raw
  modified_base (524)..(524): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtatggctgtgtttattggggcctaggggacnccctggtcaccg

SEQ ID NO: 533398 - DNA, 514 bp, Homo sapiens
  misc_feature: HEFZJCU01CCGJG.40.81.H04.1.454.heavy.3.raw
tctagcgactcacgaccggtgctcgatttagtagtgtagattcgcgggggcatcacccagcaaccacatctgtcctctagagaatcccctgagagctccgttcctcaccatggactggacctggaggatcctcttcttggtggcagcagccgcaggagcccactcccaggtgcagctggtgcagtctgggctgaggtgaagaagcctggggcctcggtgaaggtctcctgcaagatttctggaaacaccctgagcaactactacatacactggatgcggcaggcccctggacaggggtttgagtggatggggtggagtcaaccctaccagaggtggcacaaagtatcgacagaactttcagggcagggtcaccatgacctgggacgcgtccatcagcacagtctacataggatctgagcggactgacctcgtgacgacacggccatgtattactgtaggaagacgacgtttggtaggtctaccggcggggctaggacctaactcggggcctaac

SEQ ID NO: 533399 - DNA, 516 bp, Homo sapiens
  misc_feature: HEFZJCU01AMSAW.13.76.G10.1.454.heavy.3.raw
tcacgtactacacgaccggtgctcgatttagtcactcatacagggggggagaggagcccagcactgggattccgaggtgtttccatcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttacacgctatggacgtctggggccaagggacc

SEQ ID NO: 533400 - DNA, 567 bp, Homo sapiens
  misc_feature: HEFZJCU01BDWKE.14.57.F02.1.454.heavy.3.raw
  modified_base (385)..(385): a, c, t, g, unknown or other
  modified_base (393)..(393): a, c, t, g, unknown or other
  modified_base (451)..(451): a, c, t, g, unknown or other
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgngtgaaagntacgaagtctatgatacccaatttgggagggcctttcatgtctggggccaaggggacncgtgtcgaccgtcgtcttctagcctccaccaacgggacccgactcggtcgttcccccttcggccgaccccgtcccttcccaacgtaaggccaccttcctggggggtccgaccagcc

SEQ ID NO: 533401 - DNA, 523 bp, Homo sapiens
  misc_feature: HEFZJCU01BXR35.18.33.C11.1.454.heavy.3.raw
  modified_base (509)..(509): a, c, t, g, unknown or other
  modified_base (514)..(514): a, c, t, g, unknown or other
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcgaccatctcagaagacaattccaggaacacattgtatcttcaaatgaataacctgagagccgaggacacggccatgtattactgtagtggggcatttactgaccctgggccgggaacctgtcacgtcnccccncctccaccg

SEQ ID NO: 533402 - DNA, 505 bp, Homo sapiens
  misc_feature: HEFZJCU01DFG1D.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagcgtattatctcggaaccccgatcgt

SEQ ID NO: 533403 - DNA, 547 bp, Homo sapiens
  misc_feature: HEFZJCU01CY83R.48.22.B11.1.454.heavy.3.raw
agtatacatacacgaccggtgctcgatttagacgacagctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaccaattctccctgaagctgagctctgtgaccgccgcagacacggctgtctattactgtgcgaggccccgagccgcacgtggtcgtttttgtagttgtccgttttgtattaattggttcggggggcccggaaacggggggaaccgaaagttacgggtccgtaacccggtccgtttccg

SEQ ID NO: 533404 - DNA, 526 bp, Homo sapiens
  misc_feature: HEFZJCU01DKYVH.47.55.E11.1.454.heavy.3.raw
  modified_base (415)..(415): a, c, t, g, unknown or other
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcggcatctccagagacaacggcaagagtattactgtntctggaatgaacaatctgagagtcgacgatacggctgtctatcattgtgttttcgatgtcctttcggtccggcgggactttcgtcgggggccaaggggacccctggtaccg

SEQ ID NO: 533405 - DNA, 525 bp, Homo sapiens
  misc_feature: HEFZJCU01DSHMW.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtgattgactactggggccagggaaccctggtcaccgtctcctcagcctccacc

SEQ ID NO: 533406 - DNA, 546 bp, Homo sapiens
  misc_feature: HEFZJCU01CV30W.40.57.F02.1.454.heavy.3.raw
  modified_base (385)..(385): a, c, t, g, unknown or other
tctagcgactcacgaccggtgctcgatttagctcgatatagttgggtttggggtctgagagaggagcccagccctgggactttcaggtgttttcatttggtgatcaggactgaacagagagacctcaccatggactttgggctgaggtggctttttcttgtggctcttttaaaaggtgtccagtgtgaggtgcagttattggagtcggggggaggcttaatacagccggggggtccctgagactcgcctgtacagcctctggactcacctttagaaatgatgccttgagctgggtccgccaggctgcagggaaggggctggaatgggtctctattattagtggtaggacagatagtcgaaaactcgctgactccgtgaagggccnttcaccatctccagagacgtttccaacaacacgatctttctggagatgaatagcctgagagccgaggacacggccaaatattactgtgcgaaaagaacctctattgtagtggtggaagttgtaactactactttgatttcctggggtaccagggtaacccg

SEQ ID NO: 533407 - DNA, 518 bp, Homo sapiens
  misc_feature: HEFZJCU01CIKCO.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgaggagcctgacatctgacgacacggccgtctattacgtgtgcgagacgtcccacgatccgggtagacgcctacggcagccggtcctttgacttcgtggggccagggtacg

SEQ ID NO: 533408 - DNA, 515 bp, Homo sapiens
  misc_feature: HEFZJCU01EJR3D.48.23.C01.1.454.heavy.3.raw
  modified_base (464)..(464): a, c, t, g, unknown or other
agtatacatacacgaccggtgctcgatttagtacacgtgattagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtcttattactgtgcgacggccccgagcgcagtcggtnttttgatcgtctttgtagtatgttggggccgaacggggacaagtggtaccg

SEQ ID NO: 533409 - DNA, 336 bp, Homo sapiens; identical to SEQ ID NO: 444510
  misc_feature: HEFZJCU01AMZRA.3.31.C09.1.454.heavy.3.raw

SEQ ID NO: 533410 - DNA, 484 bp, Homo sapiens
  misc_feature: HEFZJCU01DLSXH.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctcggcaccctcctccaagagcacctctgggggcacagcggccctgggctgcctcggtcaaggactacttcctagagacacg

SEQ ID NO: 533411 - DNA, 495 bp, Homo sapiens
  misc_feature: HEFZJCU01B36UC.49.38.D05.1.454.heavy.3.raw
agtcgagagacacgaccggtgctcgatttagtatctgatagttgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaatttccaagaacacactatatcttcaaatgaacactctgagacgtgaggacacggctgtctattactgtgtcgactgagatgtcttattacgatgccagtgctttagtaccgttcgaccccgtggggccgaggggagccctggtccaccgtctcctcagcttccaccacggccatcggtccttcccctgccgcc

SEQ ID NO: 533412 - DNA, 493 bp, Homo sapiens
  misc_feature: HEFZJCU01DF7Q1.47.85.H08.1.454.heavy.3.raw
  modified_base (455)..(455): a, c, t, g, unknown or other
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggactccctgagactctcctgtgcagcctctggcttcaccttcaataattatgctatgcagtgggtccgccaggctccaggcaaggggctagagtgggtggcggttcatatcgtccagtggacatcttcagtattacgcagactccctgagggccgattcaccatctccagagacaattcccagaacacggtctatctgcacctgaccagcctgagaactgaacganacgtctctctactactgtgcgagagagttgacgagtct

SEQ ID NO: 533413 - DNA, 521 bp, Homo sapiens
  misc_feature: HEFZJCU01A9PXG.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtattctgtcaaatgaacagcctgagagccgacgacacggccatatattaactgtgcgaaagcgaccggcagttagtcacccgatactacttttgactacgtggggcctaacc

SEQ ID NO: 533414 - DNA, 507 bp, Homo sapiens
  misc_feature: HEFZJCU01C4DQ3.10.34.D01.1.454.heavy.3.raw
catagtagtgcacgaccggtgctcgatttagatcgtctgtgttgggtttggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccatattaaaaatcaaagctgatggtgggacaacagagcacgctgcacccgtgaaaggcagattcagcatctcaagagatgattcaaaaagtacgctgtatctgaacatgaacagcctgaaaacggaggacacagccgtgtattactgtgccactcagggaccgataatttgttt

SEQ ID NO: 533415 - DNA, 382 bp, Homo sapiens
  misc_feature: HEFZJCU01D6RNH.9.53.E09.1.454.heavy.3.raw
tgatacgtctcacgaccggtgctcgatttagagagagtgtgttggggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttccccctggcgccctgctccaggagcacctccgagacgcacagcggccctgggctgcctggtcaaggactacttccagacgtatca

SEQ ID NO: 533416 - DNA, 551 bp, Homo sapiens
  misc_feature: HEFZJCU01BYGKF.18.33.C11.1.454.heavy.3.raw
  modified_base (392)..(392): a, c, t, g, unknown or other
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccagggaagggcctggagtggatctcacttatttatagtggtggtaccacatactacacagactccgtgaagggccgattcaccatctcanaagacaaattccaggaacacattgtatcttcaaatgaataacctgagagccggaggacacgggccatgtattactgtgtggggctatttacttaggacccctggggggacccgggggaaccccgttgggtccaccggtcctccccaccccttccaaccc

SEQ ID NO: 533417 - DNA, 537 bp, Homo sapiens
  misc_feature: HEFZJCU01A0XCD.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagtttacggtggactctgtgaagggccgtttcaccatctccagagacaacgccaagaattcactgtatctacaactgaacagcctgagagtcgcagacacggccgtgtattactgtgcgagatgtagaaaaagtaatggctgtgtttattggggccaggggagcccgtggtcaccg

SEQ ID NO: 533418 - DNA, 504 bp, Homo sapiens; identical to SEQ ID NO: 497939
  misc_feature: HEFZJCU01CUEEB.17.10.A10.1.454.heavy.3.raw

SEQ ID NO: 533419 - DNA, 505 bp, Homo sapiens
  misc_feature: HEFZJCU01EU73A.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggttgggacgacattctacggagactccatggagggccgattcaccatctccagagacttttctcagaacacactgtctcttcaatgaacagcctgagggccgaggacacggcgtctattattgtgtgagtagtttatggcgatggctgggtggacagatcac

SEQ ID NO: 533420 - DNA, 485 bp, Homo sapiens
  misc_feature: HEFZJCU01CZZ1M.19.36.D03.1.454.heavy.3.raw
tactctcgtgcacgaccggtgctcgatttagctgcgtcacgacccaaaaaccacacccctccttgggagaatcccctagatcacagctcctcaccatggactggacctggagcatccttttcttggtggcagcagcaacaggtgcccactctcagggtcagctggtgcagtctggagctgaggttaagaagcctggggcctcagtgaaggtcgcctgcaaggcctctgattacacctttagcaactacggcatcacctgggtgcgacaggcccctggacaagggcttgagtggatgggatggatcagcgcttacagtcataacacaaactatgcaccgaaactccagggcagagtcaccataaccacagacacatccacgagcacagcctacatggaactgaggagcctgagagctgacgacaccggccgtgtatttactgtgcgaaatgggggaggaagttattacgttactgatggcttaccc

SEQ ID NO: 533421 - DNA, 542 bp, Homo sapiens
  misc_feature: HEFZJCU01DIMXL.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagttttccctgacgctgacgtctgtgaccgccgcagacacggctgtctattattgtgcgagactagcctttctgtaggtgggggtactttggccgaacccggggtataaccttactccctaccttcggtcgtttcgggacattccgtgggggtccggacc

SEQ ID NO: 533422 - DNA, 496 bp, Homo sapiens
  misc_feature: HEFZJCU01BP0OK.17.86.H09.1.454.heavy.3.raw
  modified_base (474)..(474): a, c, t, g, unknown or other
  modified_base (489)..(489): a, c, t, g, unknown or other
cgtagactagcacgaccggtgctcgatttagtgctatagacttgggtttggggtctgggagaggagccccagccctgagattcccaggtgtttccattcagtgatcagcactgaacacagaggactcaccatggagttggggactgagctggattttccttttggctactctaaaaggtgtccagtgtgaagtgcagctggtggagtctgggggaggcttggtacagcctggcaggtccctgagactctcctgtgcagcctctggattcacctttgatgattatggcatgcactgggtccgccaagccccagggaagggcctggagtgggtctcaggcattagttggaatgggtggtagcatagcctatgcggactccgtgaagggccgattcaccatctccagagacaacgccgaaattccctagtatctgcagatgaacagtctgagagctgaagacacggccatatatttntgtgtgaaaccatcncgccaac

SEQ ID NO: 533423 - DNA, 524 bp, Homo sapiens
  misc_feature: HEFZJCU01A9M0S.16.27.C05.1.454.heavy.3.raw
  modified_base (478)..(478): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccacgagacaattccaagaacaggggtgtttctccaagtgattgatctgagaagtgaggacacggctgtttatactgtgcgcggngctgaccgctctgactactggggccggggagccccggtcatcgtct

SEQ ID NO: 533424 - DNA, 543 bp, Homo sapiens
  misc_feature: HEFZJCU01AQA0T.12.40.D07.1.454.heavy.3.raw
atacgacgtacacgaccggtgctcgatttagtgatagagcgtaacaacagagggctcaccatggagtttgggctgagctaggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaatagacagcctgagaccagacgacacggctgtctattattgcgcgagagagacacacgaacctactggccaatactatgggggcttgttctggggccgagggggaccctgggtcagtcgtcctcccccagcctcccaccaacggggcccctatccggtccttcccccgtcggccgtccctc

SEQ ID NO: 533425 - DNA, 509 bp, Homo sapiens
  misc_feature: HEFZJCU01AYQTC.10.38.D05.1.454.heavy.3.raw
  modified_base (476)..(476): a, c, t, g, unknown or other
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgaacntgactacgctcaattctcggggccaggggaccg

SEQ ID NO: 533426 - DNA, 528 bp, Homo sapiens
  misc_feature: HEFZJCU01C62M2.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccaacgaaccgttactaaccgctatggacgtctgggggcccaaggggacccg

SEQ ID NO: 533427 - DNA, 528 bp, Homo sapiens
  misc_feature: HEFZJCU01EPRG5.51.30.C08.1.454.heavy.3.raw
cgatcgtatacacgaccggtgctcgatttagtctgacgtcaaagggaaaggggggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcactgtctctggtggctccatcagcagcagtagttacttctggggctggatccgccagcccccagggaagggactggagtggatagggaatgtccattatagtgggagcacctactacaatccgtccctcaacagtcgagtcaccatatccgttgacacgtccaagaaccaattcttcctgagctgaccctctgtgaccgccgcagatacggcagtttattactgtgcaagaaagaactaccttagaaaactggggccacggaaccctggtcaccgtctcctcagcctccaccaacgggcccactcggtctccccctggccacccgtcctccaa

SEQ ID NO: 533428 - DNA, 504 bp, Homo sapiens
  misc_feature: HEFZJCU01E1R2F.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgactccggtgacgtcctacggcaggccggccttttgactttcgt

SEQ ID NO: 533429 - DNA, 512 bp, Homo sapiens
  misc_feature: HEFZJCU01CF6UT.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcggctggtggagtctggggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccggaggacacaagccgtctattactgtgtagggtagtttacgtagttttgagt

SEQ ID NO: 533430 - DNA, 545 bp, Homo sapiens
  misc_feature: HEFZJCU01B5X0X.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtcggtccttacaatgaccaccatggaccctgtggacacagccacatatttctgtgcacactctataggagcacctggtagtctgccaaactggttccgacccctgggggcccgggaaccctggtcaccgtctccgtccagcctccaccaaacggggcccaatccggtcttccccctc

SEQ ID NO: 533431 - DNA, 521 bp, Homo sapiens
  misc_feature: HEFZJCU01ANJ1R.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgcaagctccaggcaagggattggagtgggtggcagttgtttcatctgagggcagtgttcaatggtatgcagactccgtgagggccgattcaccatctccagagacaattccaggaacacaatgtatttggaaatgaacagcctaagtcctgaggtacacgggtgtatactaactgtacgaaggaggggggaaccaggacgggagttccaagtacttaccg

SEQ ID NO: 533432 - DNA, 508 bp, Homo sapiens
  misc_feature: HEFZJCU01C7OZT.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccaacgactccggtgagccgtacggcaggcggcctttgacttcgtc

SEQ ID NO: 533433 - DNA, 562 bp, Homo sapiens
  misc_feature: HEFZJCU01ELGR5.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggcttgtttattactgttgcgtcgggtggtccgtggaacccgcttcgtttgaccttacgtcggggggcccgggggaacggtcccccggtactactccggtccttcccg

SEQ ID NO: 533434 - DNA, 530 bp, Homo sapiens
  misc_feature: HEFZJCU01BBDFR.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcaggactcaccataaccgcggacaaattaacgaacacagttaatctggagctgaacagcctgtcatctgaggacacgggcttctacttctgtgcgaggagtaattactatacactgctcctttttacacctcccttgacttctggggccatcggaaccccggtcc

SEQ ID NO: 533435 - DNA, 527 bp, Homo sapiens
  misc_feature: HEFZJCU01BME8N.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaaacaacctgagagccgacgacacggccgtttattacctgtgcgagagattcgagtggttcggggacctcaccctggttctacttcgatctctggggccgtc

SEQ ID NO: 533436 - DNA, 505 bp, Homo sapiens
  misc_feature: HEFZJCU01EI0ZO.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcacgcctccaccaagggcccatcggtcttcccctggccgcctgctccgaggagcaccgtccgagagcacagcggccctggggcctgccgtggtcaaggacttaccg

SEQ ID NO: 533437 - DNA, 522 bp, Homo sapiens
  misc_feature: HEFZJCU01ELM71.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagaccaagacagattttggagttggttacttgttgggtaccttactttgactacgtgggggcccaggggaacccctggt

SEQ ID NO: 533438 - DNA, 523 bp, Homo sapiens
  misc_feature: HEFZJCU01BFAW3.26.57.F02.1.454.heavy.3.raw
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccggggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggttcaccatctccagagatgattcagagaacacggcgtatctgcaaatgaacagcctagaaaaccgagacgacggccgtgtattactgtgcagacatccgtcgtattacgtatttttctagtggtacccg

SEQ ID NO: 533439 - DNA, 537 bp, Homo sapiens
  misc_feature: HEFZJCU01D0ESE.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattcccagaaacaaactgtatcttcaaataaacagtctgagacttgaggacacggctggtctattactgtgcgagagactacggtgaccttttctggtatttcgatctctggggccgtggcaccctggtcactgtctcctcggcttccaccaagggccccatccggttccttcccccttggccgcccctcgcctccacggtagcaccctcgtcgggggcgaccgagccggtccccg

SEQ ID NO: 533440 - DNA, 529 bp, Homo sapiens
  misc_feature: HEFZJCU01DOSE3.49.81.H04.1.454.heavy.3.raw
agtcgagagacacgaccggtgctcgatttagtagtgtagattcgcggggggggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgtattcgaccatctccagagacaattccaagaacacgctatatttgcacatgaacagcctgagagcgtgaggacacggcttagtttattacttgtgcgaacttaatcgacggaggacaaggggtcgacccccgtcacctcggtacggtac

SEQ ID NO: 533441 - DNA, 537 bp, Homo sapiens
  misc_feature: HEFZJCU01DCHAS.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattgggatacatctattactttgggagcacctactacaacccgtcctcaagagtcgagtaacgatctcagtggacacgtctaacaatcacctctccctgaggctgagctctgtgacagccgcggacacgggcgtttatactgtgcgagagggacggactacggtgacttacgtgggggttcgaccccgtggggggcccacgggggaaccctggtcgaccgtctcctcagccctccaaccg

SEQ ID NO: 533442 - DNA, 497 bp, Homo sapiens; identical to SEQ ID NO: 474197
  misc_feature: HEFZJCU01BE4IL.12.55.E11.1.454.heavy.3.raw

SEQ ID NO: 533443 - DNA, 521 bp, Homo sapiens
  misc_feature: HEFZJCU01EGPSH.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttttaaaaggtgcccagtgtgaggtgcagctggtggagtctggaggaggcttggatccagcctggggggtccctgagactctcctgtgcagcctctgggttcaccgtcagtcacacctacatgagctgggtccgccaggctccagggaaggggccggagtgcgtctcttttatttatagtagtggtagtacatactccgcagactccgtggaggggccgattccaccatctccagagacaattccaagaacacgctgtttcttcaaatgaacagcctgagagccgatgaacacggccgtgtattactgtgcgagagagtggggcccaacggaacgttactacgctagtggacgtcgtcggggcc

SEQ ID NO: 533444 - DNA, 511 bp, Homo sapiens
  misc_feature: HEFZJCU01ARSCI.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacgacggccgtatatttctgtcgcgagagacgtaaagtagacgtaggtagttccggggggtacacatgacaccg

SEQ ID NO: 533445 - DNA, 520 bp, Homo sapiens
  misc_feature: HEFZJCU01C1JDF.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggcctggcacctgtatccgaccgttggagtcagggaactctggtcaccgtctcctcagcctccaccaagggcccatcggtcttcccctggcgccctgctccaggagcacctccgagagcacagcggcccgtcgggcgtcg

SEQ ID NO: 533446 - DNA, 506 bp, Homo sapiens; identical to SEQ ID NO: 478854
  misc_feature: HEFZJCU01CTDL0.11.57.F02.1.454.heavy.3.raw

SEQ ID NO: 533447 - DNA, 473 bp, Homo sapiens
  misc_feature: HEFZJCU01A5TM6.48.51.E07.1.454.heavy.3.raw
agtatacatacacgaccggtgctcgatttagcatactctacaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggccctggacaagggcttgagtggatgggatggatctatcctaccagtggtggcacacgctattcacagaagtttcagggcaggggtcaccatgaccagggacacgtccatcagcacagcctacatggtaattggagcaggctgacatctgacgacacggccgttagtattattgtgcgagag

SEQ ID NO: 533448 - DNA, 532 bp, Homo sapiens
  misc_feature: HEFZJCU01DUOQZ.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttacggacctagcttgtttaaaaactaccttaactacggtctggacgtcgtgggggccgagggggacctaaac

SEQ ID NO: 533449 - DNA, 514 bp, Homo sapiens
  misc_feature: HEFZJCU01CQ5VA.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaggtctcctgcgaggcttctggttacacctttctcaggtatactattgcctgggtgcgacaggcccctggacaagggcttgagtggatggggtggatcaacggtacagactggtggcacagactatgcacaggggctccagggcagactcaccagtgaccacagacacatcagcgaacacagtcaacatggagttgcggagcctgcgatctgacgacgcggccgtatattactgtgcgagagtacgtagcggctcgtcctttgactactcgggcctgggaactctggtcaccgtct

SEQ ID NO: 533450 - DNA, 381 bp, Homo sapiens; identical to SEQ ID NO: 445431
  misc_feature: HEFZJCU01AYAJ8.3.70.G04.1.454.heavy.3.raw

SEQ ID NO: 533451 - DNA, 488 bp, Homo sapiens
  misc_feature: HEFZJCU01ERBSF.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgacctaacagcggtggcacaaagtatgcacaagaagtttcagggtcagggtcaccatgaccagggacacgtccatcagcacgtccatcaacacacgcctacatggacctgagcggcctgacatctgaccgacacgggcgtatattttctgtggcgagggagta

SEQ ID NO: 533452 - DNA, 509 bp, Homo sapiens
  misc_feature: HEFZJCU01DCR5C.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctggtcttattactgtgcgagagactacggtgaccttttctggtatttcgatctctggggccgtggcaccctggtcactgtctcctcggcttccaccaagggcccatcggtcttcccctcggcgccctcgctccaggacgcacctcgtggggcg

SEQ ID NO: 533453 - DNA, 508 bp, Homo sapiens
  misc_feature: HEFZJCU01E0TS3.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctgggctgcctggtcaaggactacttccaagtgcgtct

SEQ ID NO: 533454 - DNA, 513 bp, Homo sapiens
  misc_feature: HEFZJCU01CIHJ9.51.31.C09.1.454.heavy.3.raw
  modified_base (429)..(429): a, c, t, g, unknown or other
cgatcgtatacacgaccggtgctcgatttagacgtctcatcaaggaaggaaggggagctctgagagaggagcccagccctgggattttcaggtgttttcatgtggtgatcaggactgaacagagagaactcaccatggagtctgggctgacgtggctttttcttgtggctattttaaaaggtgtccagtgtgacgtgcagctggtggagtctgggggaggcttgatacagccgggggggtccctgagactctcatgtagaacctctggcttcatgtttagagtctatgacatgagttgggtccgccaggctccggggaaggggctggagtgggtctcaatgatcagtgatggtggaacgaccacaaactacgccgactccgtgaagggccggtgcaccatctccagagacaattcgaaggacactttanatctgcaactcaacagactgacacccgcggacacggccgtctactactgtgtgaaagaagacggaccgctagggacgaggagcc

SEQ ID NO: 533455 - DNA, 501 bp, Homo sapiens; identical to SEQ ID NO: 455940
  misc_feature: HEFZJCU01CI3B7.11.19.B08.1.454.heavy.3.raw

SEQ ID NO: 533456 - DNA, 384 bp, Homo sapiens; identical to SEQ ID NO: 451361
  misc_feature: HEFZJCU01AZP9E.18.60.F05.1.454.heavy.3.raw

SEQ ID NO: 533457 - DNA, 526 bp, Homo sapiens
  misc_feature: HEFZJCU01DPUNY.16.35.D02.1.454.heavy.3.raw
tgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcggaccaccgccatactatttactgtgcgagtccggtttatcgccgcagatcactactactaactacggtctggacgtcgtggggccagggtaaccg

SEQ ID NO: 533458 - DNA, 517 bp, Homo sapiens
  misc_feature: HEFZJCU01D2N6P.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctgggctggatccgccagcccccagggaaggggctggagtggattgggagtatttaccacagtgggagcacctactacaacccgtccctcaaaagtcgaggcaccatatccgtagacacgtccaagaaccaattctaccctgaagctgagctctgtgaccgccgcagacacggctgtctattactgtgcgaggccccgagcgcagtggtcttttgtatgtcctttggattagtgtgggggtccgaacggggacaaagtcggtctacccgtcttcc

SEQ ID NO: 533459 - DNA, 417 bp, Homo sapiens
  misc_feature: HEFZJCU01B7Z2A.13.10.A10.1.454.heavy.3.raw
tcacgtactacacgaccggtgctcgatttagcgtcgatctcaggggtccgccaggctccagggaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgaccctgggcccggaacctggtcaccgtctcctcagcctccaccaagggcccatcggtccttcccctggcaccctcctccaagagcacctctggggcacagcggccctgggctgcctggtcaaggactacttcctagtacgtga

SEQ ID NO: 533460 - DNA, 532 bp, Homo sapiens
  misc_feature: HEFZJCU01C0OC0.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgactttctggggccagtcggaaccccggtcaccgt

SEQ ID NO: 533461 - DNA, 523 bp, Homo sapiens
  misc_feature: HEFZJCU01A20B9.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactgggcagggaaccctggtcaccgtctcctcagcctccg

SEQ ID NO: 533462 - DNA, 492 bp, Homo sapiens; identical to SEQ ID NO: 447005
  misc_feature: HEFZJCU01D3F96.53.26.C04.1.454.heavy.3.raw

SEQ ID NO: 533463 - DNA, 540 bp, Homo sapiens
  misc_feature: HEFZJCU01CBFYV.53.64.F09.1.454.heavy.3.raw
  modified_base (447)..(447): a, c, t, g, unknown or other
  modified_base (494)..(494): a, c, t, g, unknown or other
cgcgtatacacacgaccggtgctcgatttagcgcgtatacaaggggtctgagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcggggggaggcttggtacagccgggggggtccctgagactctcctgtagagtctctggcttcacctttagagtctatgacatgagttgggtccgccaggctccggggaagggctggagtgggtctcaacgatcagtgatagcggaagtaccacaaactacgccgcctccgtgaagggccgatgcaccgtctccagagacaattcgaaggacactttatatctgcaacctcaacagactgacaaccgctnacacggccgtctattactgtgtcaaagaagacgggaccgctggacgnggaacgccaaggaggaaaaactcgaccttactttagacttaacgtc

SEQ ID NO: 533464 - DNA, 494 bp, Homo sapiens
  misc_feature: HEFZJCU01EEFQS.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctgggagtggggtggcagttatttcatatgatggaaatagtgacttctattcagactccgtgaagggccgattcaccgtctccagagacaattccaggcacacgctgtatctgacaaatgaacacgcctgaggagctggaggacacgggctagtgtaattactgtgcgaaagt

SEQ ID NO: 533465 - DNA, 503 bp, Homo sapiens
  misc_feature: HEFZJCU01AJDBS.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaacgggccgattcaccatctccagagacaattccaagaacacgcagtatctgcaaatgaacagcctgagagcgtgaggacacggctggtgtattactggtgggagtagagtggaaggtcggatattgtta

SEQ ID NO: 533466 - DNA, 521 bp, Homo sapiens
  misc_feature: HEFZJCU01DTT6W.2.16.B05.1.454.heavy.3.raw
  modified_base (466)..(466): a, c, t, g, unknown or other
  modified_base (489)..(489): a, c, t, g, unknown or other
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaagggctggagtgggtggccagcatgaacggagatggaagtcaaaagaactatgtggactctgtgaagggccgattcaccatctccagagacaacgccaaagaactcactgtatctgcaaatgaacagcctaagacccgaggacacggctggtntattactgtgcgagagacccgtntacgtgggggccccgggagccccgtggtaccg

SEQ ID NO: 533467 - DNA, 432 bp, Homo sapiens
  misc_feature: HEFZJCU01CDXOJ.52.82.H05.1.454.heavy.3.raw
cgcagtacgacacgaccggtgctcgatttagtcgagctctctcgcgggcacgaccggtgctcgatttagtcacgcgagaaagggaaaggggctggagtgggtttcatacagtagtggttctagtactttcgcaaagtacgcagactctgtgaagggccgattcaccgtgtccagagacaacgccaagaactcaatgtatctgcagatgagcaacctgagagtcgacgacacggctgtttattactgttcgagactagcggatttttgggggtcggaatcacttgactactggggccagggagccctggtcaccgtctcctctgcctccaccaagggcccatcggtcttccccctcggcaccctcctccaagagcacctctgggggcacagcggccctgggctgcctggtcaaggactactcctatacgatcg

SEQ ID NO: 533468 - DNA, 525 bp, Homo sapiens
  misc_feature: HEFZJCU01BI4LE.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggaccttttgggggtttcgaccccgtgggggccagggaaccctggtcaccggtctcctcagcctccaccaagggccccagtcggtcttccccctggcaccctcctccaag

SEQ ID NO: 533469 - DNA, 527 bp, Homo sapiens
  misc_feature: HEFZJCU01C6ISC.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgacccgtgaagggccgattaaccatctccagagacgattccgagaacacggtgtatcttcaaatgaacaacctgagagccgacgaccacggccgtttattacgtgtgcgagagattcgagtcggttcggggacctcaccctggttctacttcgatctctggggccgtc

SEQ ID NO: 533470 - DNA, 501 bp, Homo sapiens
  misc_feature: HEFZJCU01C3CU2.17.10.A10.1.454.heavy.3.raw
  modified_base (475)..(475): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttnataggctctatggactggacttcgtc

SEQ ID NO: 533471 - DNA, 529 bp, Homo sapiens
  misc_feature: HEFZJCU01CROVE.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaagtaataggctgtgtttagtgggcagggagcctggtcacgt

SEQ ID NO: 533472 - DNA, 482 bp, Homo sapiens
  misc_feature: HEFZJCU01CA9X9.51.73.G07.1.454.heavy.3.raw
  modified_base (417)..(417): a, c, t, g, unknown or other
cgatcgtatacacgaccggtgctcgatttagctctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgccacagaagtttcagggcgaggggtcaccatgaccgagggacaagtccaaccaacacacgaccgtacanggaaacgtaaaggggactgaacatactgacgacaccggaccatgtattattagtgcgtagagaaa

SEQ ID NO: 533473 - DNA, 524 bp, Homo sapiens
  misc_feature: HEFZJCU01C0A9I.51.5.A05.1.454.heavy.3.raw
cgatcgtatacacgaccggtgctcgatttagatagatagacaggggagtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacggtgtctatttctgtgtcgagactgcccggtcctgcacctcgtgtcggcccctaagtttcggtttaccggcaccaccaaaatcgaagggacgaacgtcctacgacgggtcctac

SEQ ID NO: 533474 - DNA, 493 bp, Homo sapiens; identical to SEQ ID NO: 453100
  misc_feature: HEFZJCU01C8AOX.14.25.C03.1.454.heavy.3.raw

SEQ ID NO: 533475 - DNA, 528 bp, Homo sapiens
  misc_feature: HEFZJCU01ETGTI.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcgaccatctccagagacaattacaagaacaccctttatctgcaaatagacagcctgagaccagacgacacggctgtctattattgcgcgagagagacacacgaacctactggccaatactatgggggcttgttcgtggggccgaggggaccctggtcatcgtctccccagccttccaccaacgggcccatccggtcttcccctggccg

SEQ ID NO: 533476 - DNA, 520 bp, Homo sapiens; identical to SEQ ID NO: 445471
  misc_feature: HEFZJCU01C4BMQ.12.40.D07.1.454.heavy.3.raw

SEQ ID NO: 533477 - DNA, 499 bp, Homo sapiens
  misc_feature: HEFZJCU01AWR3A.17.10.A10.1.454.heavy.3.raw
  modified_base (483)..(483): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtgggtgggtcagcggctttgacggtaaggcacagtatgcaccgaagatgaagggcagagtcacgattaccacggacaccccacgaacacagtctacatgcaactgacgagcctgagagctgacgacacggccgtctattactgtgcgagaatgttttctgtcatcgtactaatttgataggctntatgagtggacttgtc

SEQ ID NO: 533478 - DNA, 507 bp, Homo sapiens
  misc_feature: HEFZJCU01DSDHD.3.67.G01.1.454.heavy.3.raw
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttcctgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtaatttattgtactagttaaggacaactatacg

SEQ ID NO: 533479 - DNA, 515 bp, Homo sapiens
  misc_feature: HEFZJCU01CZXIC.12.75.G09.1.454.heavy.3.raw
  modified_base (387)..(387): a, c, t, g, unknown or other
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagntctgaagacacggccatttattactgtgcgagagagtgcaggggccctcccgacacttcgggtttattttcttttagaccttccgtcggggcccaggggtaacccctgggtaccaccgtcctcctccg

SEQ ID NO: 533480 - DNA, 536 bp, Homo sapiens
  misc_feature: HEFZJCU01B3WSI.3.55.E11.1.454.heavy.3.raw
agacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaatattacgcagactccctgaagggtcgattcaccatctccagagacaattccaacaacaccctgtatttgcaaatgaacagcctgagaactgaagacacggctatctattactgtgcgagagatcaagtccggacgacgaaatgactacggtggtaaccttccagactactggggccagggaaccctggtcaccgtctcctcagcctccaccgaagggcccatccgggtccttccccctcgggccaacccctccctccccaagacgg

SEQ ID NO: 533481 - DNA, 537 bp, Homo sapiens
  misc_feature: HEFZJCU01CVT5B.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactggggaaccccactatgcccaggccttcacagggcggtttgtcttctccatggatacctctgtcgggacggcttatctgcagataaccaaccttcaacctgacgacactgccgtttatttttgttacgtagagcgtcgtctgtcagtggaattgactactggggcgacgggacctggtcaccgtctcctcagcctccaccaacgggccc

SEQ ID NO: 533482 - DNA, 532 bp, Homo sapiens
  misc_feature: HEFZJCU01AUERM.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaactgaccgctgtgaccgccgcggacacggctgtgtattactgtgcgagacgaactgggcgggtggctacgacttgacttttgggggccaggggaaaccgtggtcgaccgtcctccccagcttccaccacgggcccatcggtccttcccccg

SEQ ID NO: 533483 - DNA, 475 bp, Homo sapiens
  misc_feature: HEFZJCU01DY3UG.14.57.F02.1.454.heavy.3.raw
cgtctagtaccacgaccggtgctcgatttagctcgatatagttgggtttgggctgagttggctctttcttgtggctattttaaaaggtgcccagtgtgaggtgcagctggtggagtctggaggaggcttgatccgagcctgggggtccctgagactctcctgtgcagcctctgggttcaccgtcagtcacacctacatgagctgggtccgccaggctccagggaaggggctggagtgcgtctcttttattatagtagtggtagtacatactccgcagactccgtgaggggccgattcaccatctccagagacaattccaagacacgctgtttcttcaaatggaacagcctgagagccgatgacacggcctgtattacgtgtgtcgagagatggggcccacgaacgttactacgctatggacgtctcggggtccgaacgggaccgacggtcgaccgtctcctctacgcctcccacc

SEQ ID NO: 533484 - DNA, 515 bp, Homo sapiens
  misc_feature: HEFZJCU01BIV8J.49.55.E11.1.454.heavy.3.raw
agtcgagagacacgaccggtgctcgatttagcactcgcacgttgggtttggggagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatgggtggtatcacctactatgcagactctgtgaagggtcgattcaccatctccagagacaacagcaagaaactaccctgtatctgcaatgaacagtctcagaggtggaggacgaccgtccttcctactactgtgtacaaagattaacgtgaccacacctattttga

SEQ ID NO: 533485 - DNA, 543 bp, Homo sapiens
  misc_feature: HEFZJCU01ENFAS.18.14.B03.1.454.heavy.3.raw
tacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaagggcaggttcaccgtctccagaaatgattcaaagaacacggcgtatctgcaaatgaacagcctgaaaccgaggacacggccgtgtattactgtactagacaggtggattacatttgggggagttatcgcaaacggggggggtactactacgctatggacgtctggggccaagggaccacggtcaccgtctcctcagcctccaccaagggcccatcggtcttcccctggccaccctcctccaagagcacctc

SEQ ID NO: 533486 - DNA, 504 bp, Homo sapiens
  misc_feature: HEFZJCU01CAU1P.51.64.F09.1.454.heavy.3.raw
cgatcgtatacacgaccggtgctcgatttagcgcgtatacaagggggcggtgtttccattcggtgatcagcactgaacacagaggactcaccatggagtttgggctgagctgggttttcctcgtcgttcttataagaggtgtccagtctgaggcgcagctggtggagtctgggggaggagtggtccagcctgggaggtccttgagactctcctgtgcagcctctggattcaccttcagagtctatggcatgaactgggtccgccaggctccaggcaaggggctggagtgggtggcattcatttcagaggatggaattaagagatactatacagactccgtgaagggccgattcaccatctccagagacaattccaagaactcgctctatctgcaaatgagcagcctgagacctgagacacggctgtctattactgtgcgaaacggatgagtggaactagggtttgagaacggtatggacgtctggggccgagggaccacggtac

SEQ ID NO: 533487 - DNA, 508 bp, Homo sapiens
  misc_feature: HEFZJCU01BJIZ0.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaatgaacagcctgacagtcgacgacacggccatgttattttgtgtcgagcggacccgggctcctcaatggctttcattacg

SEQ ID NO: 533488 - DNA, 494 bp, Homo sapiens
  misc_feature: HEFZJCU01CF68E.52.53.E09.1.454.heavy.3.raw
cgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatcctccagagacgagtccaggaacagcctgtttcttcaaatggacagtctgagacctgacgacacggctgtctattactgtgcgagagaacccagggggcgggagcagccccgtaacttctgggccagggaacccgggtcaccgtctcctcagcctccaccaagggcccatcggtcttcccctggcaccctcctccaagagcacctctgggggcacagcggccctgggctgcctggtcaaggactacttcctatacgatcg

SEQ ID NO: 533489 - DNA, 494 bp, Homo sapiens
  misc_feature: HEFZJCU01EB1DP.10.38.D05.1.454.heavy.3.raw
  modified_base (480)..(480): a, c, t, g, unknown or other
catagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctacttattgtgcgcgacatnactacgctcaattc

SEQ ID NO: 533490 - DNA, 422 bp, Homo sapiens
  misc_feature: HEFZJCU01DM3P7.16.78.H01.1.454.heavy.3.raw
tgtactactccacgaccggtgctcgatttagtgtgagtagtttgggtttggggcatgaactgggtccgccaggctccagggaaggggctggagtgggtctcatccattagtagtagtagtagttacatatattacgcagactcagtgaaggggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctggcaccctcctccaagagcacctctggggcacagcggccctgggctgcctggtcaaggactacttccgagtagtaca

SEQ ID NO: 533491 - DNA, 509 bp, Homo sapiens
  misc_feature: HEFZJCU01BSS2N.51.11.A11.1.454.heavy.3.raw
cgatcgtatacacgaccggtgctcgatttagctacgactgcagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtcttctctggattcaccttcagggtctatgacatgcactgggtccgccaggctccaggcaaggggctggagtgggtggcagttatatcatatgatggaagtaataaatactatgcagactccgtgaagggccgattcaccgtctccagagacaattccaagaatacgctgtatctgccacatgaacagcctgagagctgaagacacggggtgtttattactgtgcgaacttaattacggaggacaacggtaaccccgtccc

SEQ ID NO: 533492 - DNA, 498 bp, Homo sapiens
  misc_feature: HEFZJCU01EGPZ0.7.85.H08.1.454.heavy.3.raw
cgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaaggggctgcagtgggtttcacacattaatactggaagtaggaccataacttacacagactctgtgaagggccgattcaccacctccagagacgacgccaagaactcactgtctctgcaaatgaacagcctgagagtcgaggacacggctgtgtattactgtgcggagagatcccgggaggggacgta

SEQ ID NO: 533493 - DNA, 495 bp, Homo sapiens
  misc_feature: HEFZJCU01B20KA.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtatttactgtgcgaaagattttctata

SEQ ID NO: 533494 - DNA, 495 bp, Homo sapiens
  misc_feature: HEFZJCU01DUQUB.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctggggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcagtatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtct

SEQ ID NO: 533495 - DNA, 515 bp, Homo sapiens
  misc_feature: HEFZJCU01EBWU9.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaacgagcgggagttcaagtactcc

SEQ ID NO: 533496 - DNA, 490 bp, Homo sapiens
  misc_feature: HEFZJCU01BKK9V.40.71.G05.1.454.heavy.3.raw
tctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacaggcccccggacaagggcttgagtggatgggatggagcagcacttacaatggtgacacaaactatgcacagaagttccaggacagagtcaccatgaccacagacacatcccaccagccacagccctatatgggaggtgaaggagcctgacatctgacgacacggcctaatatttactgtgcgagagatcagtcggaggtggaatgccgtgt

SEQ ID NO: 533497 - DNA, 501 bp, Homo sapiens
  misc_feature: HEFZJCU01BVXHE.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccggattcaccatctccagagacaattccaagaacacgcagtatctgcaaatgaacagcctgagagctgaggacacggcgtgtgtattactgttgggagaggatggaggtcggatattgta

SEQ ID NO: 533498 - DNA, 498 bp, Homo sapiens
  misc_feature: HEFZJCU01C7WU6.11.71.G05.1.454.heavy.3.raw
  modified_base (468)..(468): a, c, t, g, unknown or other
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagtttatttcatatgatggaaatagtgacttctattcagactccgtgaagggccgattcaccgtctccagagacaattccaggcacacgctgtatctgacaatgaacagcctgagagctgaggacacggctgtgtattactgtgcgaagntttctatagaggtgacgtacgggggcttcg

SEQ ID NO: 533499 - DNA, 521 bp, Homo sapiens
  misc_feature: HEFZJCU01CRS22.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagaccctccgatagcagtggctggtccactaggtttgactactggggccagggaagctttggtctaccgtctcctcagcct

SEQ ID NO: 533500 - DNA, 553 bp, Homo sapiens
  misc_feature: HEFZJCU01CSJ20.7.70.G04.1.454.heavy.3.raw
  modified_base (356)..(356): a, c, t, g, unknown or other
cgtgtctctacacgaccggtgctcgatttagtgtagtgtgaagggaaagggtctgtgaaggcttcaccagtcctggacctcctgtgcaagaacatgaaacacctgtcggttcttcctcctgctggtggcaactcccagatgggtcctgtcccaggtgcagctgcaggagtcgggcccaggactggtgaagccttcacagaccctgtccctcacctgcactgtctctggtgactccatcagtaatgggtggctactactggagctggattcgccagcacccggggaagggcctggagtggattggatacatctattactttgggagcacctactacaacccgtccctcaagagtcgngtaacgatctcaggtggacacgtctaacaatcactctccctgaggctgagctcttgtgcagccgcggacacgggcggtttaattcgttagtggcgaggaggggacggacctacgggtgacgtaccgtggggggtttccgaccccggtggggcccgaggggaaccctgggtccaccgttctccgtcacgcctccaacc

SEQ ID NO: 533501 - DNA, 536 bp, Homo sapiens
  misc_feature: HEFZJCU01DWV4U.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggccccctggccacggccttgagtcgctggggtggatcagttgttacaacggtgacacagactttgcacagaagtttgagggcagagtcaccctgaccacagacacatccggcgaacacagcctacatgaactgaggaatctgacatactgacgacacggccgatatattactgtgcgagaaggacggttttggggcgcggactccgtcttgagtatctggggccgagggggacaaagtggtcaccggtctctttcacgtccc

SEQ ID NO: 533502 - DNA, 548 bp, Homo sapiens
  misc_feature: HEFZJCU01CJ1JI.19.10.A10.1.454.heavy.3.raw
tactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtacaagagatgattcacaaagtacagtgtatctgcaaatgaacagcctgaagaccgaggacacagccatttactattgtacaaatgaaatactgggggacggggggaaaattgggggaccaggggaacccctgggtcctccggtctcgtcaggt

SEQ ID NO: 533503 - DNA, 513 bp, Homo sapiens
  misc_feature: HEFZJCU01ECR4O.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatactgacgacacggccgtctattactgtgcgtagagtcccacgtatccggtgagcctacggcaggcggcctttggacttctggggccaggggac

SEQ ID NO: 533504 - DNA, 536 bp, Homo sapiens
  misc_feature: HEFZJCU01A75AD.17.28.C06.1.454.heavy.3.raw
  modified_base (503)..(503): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgatccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagtttacgtggactctgtgaagggccgtttcaccatctccagagacaacgccaagaattcactgtatctacaactgaacagcctgagagtcgcagacacggccgtgtattactgtgcgagatgtaggaaaagtaatggctgtntttagtggggtcaggggagccctggtcctaccg

SEQ ID NO: 533505 - DNA, 495 bp, Homo sapiens
  misc_feature: HEFZJCU01AP0OW.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacagatggcactacatattattctgacctccgtgaacgggccggttcaccctctccagagacacttccaacaacatcttgtatcttcacatgcacaatctgagagtcgacgacacggccacctattattgtgcgcgacatgactacgctcaattc

SEQ ID NO: 533506 - DNA, 321 bp, Homo sapiens
  misc_feature: HEFZJCU01B3FF3.48.27.C05.1.454.heavy.3.raw
agtatacatacacgaccggtgctcgatttagacgcgatcgaagggttggggggaagaggaagactgacggtccccccaggagttcaggtggtgcagtctggagctgaggtgaagaagcctgggcctcagtgaacgtctcctgcaaggcttctggttacacctttacctagctatgggatcagctgggtgcgacaggccctggacaagggcttgagtggatgggtatggatcaaacgcttacaacggtaactacaaactatcgcacagaagctccagggccagacgtcaccgatgaaccgacagacaccagtccaacggagc

SEQ ID NO: 533507 - DNA, 494 bp, Homo sapiens
  misc_feature: HEFZJCU01EQ0KD.48.42.D09.1.454.heavy.3.raw
  modified_base (420)..(420): a, c, t, g, unknown or other
agtatacatacacgaccggtgctcgatttagacacatacgcagggaaagggggcatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaagcctggggcctcagtgaagatttcctgcaaggcatctggatacatcttcaccacctacaatatacactgggtgcgacaggcccctcgacaagggcctgagtggatggggatgatcaaccctaggtatggcagcacaagccacgcagagaagttccagggcagagttatcatgaccagcgacacgtccacgagcacagtctacatgagtctgancagcctgagatctgaagacacgggccgtcttatttacgtgttgccggaggaggggggggttgggggtcccaaac

SEQ ID NO: 533508 - DNA, 526 bp, Homo sapiens
  misc_feature: HEFZJCU01E0UDX.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtctttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttaggatgtctggggccaaggtacagcggtcaccgtcgcctcagcctccaccaagggcccatcggtcttccccctggcaccctcctccaagacgcaccctctcggggggcacgtac

SEQ ID NO: 533509 - DNA, 515 bp, Homo sapiens
  misc_feature: HEFZJCU01DL234.13.55.E11.1.454.heavy.3.raw
tcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggtttttccttgttgctatttttaaaaggtgtccaatgtgagctgcagctggtggagtctgggggaggtttggtacagccagggcggtccctgagactctcctgtataacttctggattcaacttgggtgattatgctatgaactgggtccgccaggctccagggaaggggctggagtgggtaggtttcattaggagcaattctcatgatgggacaacagaatacgtcgcgtctgtaaaaggcagattcaccatctcaagagatgagtccagaagcatcgcctttctgcagatgagtagcctgaagaccgaggacacagccatctattactgtgctagagagtattgcaggtcctacgtacc

SEQ ID NO: 533510 - DNA, 392 bp, Homo sapiens
  misc_feature: HEFZJCU01EG6JF.49.12.B01.1.454.heavy.3.raw
agtcgagagacacgaccggtgctcgatttagtagtgtagattccgcgggcacgaccggtgctcgatttagagtagtgatcagggacattgactccgtgaagggccgattcatcatctccagagacaactccgagaacacactgtatcttcaaaatgaacaggttgagagctgaagacacggctttatattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctctctcgact

SEQ ID NO: 533511 - DNA, 552 bp, Homo sapiens
  misc_feature: HEFZJCU01ERBXT.4.12.B01.1.454.heavy.3.raw
  modified_base (354)..(354): a, c, t, g, unknown or other
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatcnccctttgacgatgacatctgtgaccgctgcggacacagccgtttattactgtgcgcgatctgggcgactcagtgactatggtatggtacgtcgtcgggggccgaacggggaccgacgggtcagtccgtcttccctccacgccctccacccaaacggggccccgatccggttcctttccccccgttcggcctacccccg

SEQ ID NO: 533512 - DNA, 539 bp, Homo sapiens
  misc_feature: HEFZJCU01DXUL0.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagtttagtggttggggggtaggtttggggttttttttcgtttacgttacggggt

SEQ ID NO: 533513 - DNA, 515 bp, Homo sapiens
  misc_feature: HEFZJCU01ETPHP.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagttacgtagcggctcgtccttttgactactggggcctgggaactctggtcaccgtct

SEQ ID NO: 533514 - DNA, 524 bp, Homo sapiens
  misc_feature: HEFZJCU01BUV2O.7.71.G05.1.454.heavy.3.raw
  modified_base (440)..(440): a, c, t, g, unknown or other
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaatgaanagcctaagtcctagaggacgacgggtgtatactactgtacgaagggtaggggggaaccgaggcggtaggttccaagtacttccg

SEQ ID NO: 533515 - DNA, 510 bp, Homo sapiens
  misc_feature: HEFZJCU01EIX6W.11.71.G05.1.454.heavy.3.raw
cgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcaggggggctggagtggggtggcagttatttcatatgatggaaatagttgacttctattcagactccgtgaacgggccgattcaccgtctccagagacaattccaggcacacgctgtatctgcaaatgaacagcctagagagctgaggacgaccgggctgtgtattactgttgcgaaagtatttctatagaggttgacgtacc

SEQ ID NO: 533516 - DNA, 499 bp, Homo sapiens
  misc_feature: HEFZJCU01B3HZM.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctctttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctcccagagacaattccaagaacacgcagtatctgcaaatgaacagcctgagagctgaggacacggctgtgttatttactgttggggagagagtggaggtcgatattgt

SEQ ID NO: 533517 - DNA, 404 bp, Homo sapiens
  misc_feature: HEFZJCU01DOC1T.10.77.G11.1.454.heavy.3.raw
catagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccggtctcctcagcctccaccaagggcccatcggtcttccccctggcaccctcctccaagagcacctctgggggcacagcggccctgggctgcctggtcaaggactacttcccactactatg

SEQ ID NO: 533518 - DNA, 524 bp, Homo sapiens
  misc_feature: HEFZJCU01EP12O.13.76.G10.1.454.heavy.3.raw
  modified_base (395)..(395): a, c, t, g, unknown or other
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagaganaattccaagaacacgctgtttcttcaaatgaacagcctgagagccgatgacacgggcccgtgtatttactgtgcgagaagagtggggcccaacgaaccgttactacgctataggacgtcgtggggaccc

SEQ ID NO: 533519 - DNA, 514 bp, Homo sapiens
  misc_feature: HEFZJCU01C7ABZ.51.31.C09.1.454.heavy.3.raw
  modified_base (496)..(496): a, c, t, g, unknown or other
cgatcgtatacacgaccggtgctcgatttagacgtctcatcaaggaaggaaggggagctctgagagaggagcccagccctgggattttcaggtgttttcatgtggtgatcaggactgaacagagagaactcaccatggagtctgggctgacgtggcttttcttgtggctattttaaaaggtgtccagtgtgacgtgcagctggtggagtctgggggaggcttgatacagccgggggggtccctgagactctcatgtagaacctctggcttcatgtttagagtctatgacatgagttgggtccgccaggctccggggaagggctggagtgggtctcaatgatcagtgatggtggaacgaccacaaactacgccgactccggtgaagggccggtgcaccatctccagagacaattcgaaggacactttatatctgcaactcaacagactgacaccgcggacacggccgtctactactgtgtgaaagaagacggtaccnctagggacaggagccaga

SEQ ID NO: 533520 - DNA, 523 bp, Homo sapiens
  misc_feature: HEFZJCU01AOVX9.26.71.G05.1.454.heavy.3.raw
agactatactcacgaccggtgctcgatttagtgtcgtcgcaagagagaggggggggggaagaggaagactgacggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattgggccagggaattttggtcaccgtctccccagcctccaccaagggcccatcggtcttcccctggcgccctgctccaggagcacctccgagagcacagccggcccgtcgggctgccgtggtcgaaggactacttccta

SEQ ID NO: 533521 - DNA, 503 bp, Homo sapiens
  misc_feature: HEFZJCU01CRFEB.10.38.D05.1.454.heavy.3.raw
  modified_base (341)..(341): a, c, t, g, unknown or other
catagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacngatggcactacatatttattctgactccgtgaagggccggttcaccctctccagagacacttccaacaacatcttgtatcttcacatgcacaatctgagagtcgacgacacggcccacctattattgtggcgcgacatgactacgctcaatttctggggcca

SEQ ID NO: 533522 - DNA, 401 bp, Homo sapiens; identical to SEQ ID NO: 468242
  misc_feature: HEFZJCU01CXUWY.47.24.C02.1.454.heavy.3.raw

SEQ ID NO: 533523 - DNA, 513 bp, Homo sapiens
  misc_feature: HEFZJCU01C6C6U.14.85.H08.1.454.heavy.3.raw
cgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccagggaaggggctggagtggattggggaaatcagtcaaagtggaggcaccaagtacaacccgtccctcgagagtcgagtcaccatatcaatagacacgttccagaatcagttctccctgaggctgacttctgtgacagccgcggacacggctgtgtattactgtgcgagatctttcggctggtacgctcttgactactgggggccagggaaccctggtcaccgtctcttcagccctccaccaagggccc

SEQ ID NO: 533524 - DNA, 397 bp, Homo sapiens
  misc_feature: HEFZJCU01BH4M4.7.60.F05.1.454.heavy.3.raw
cgtgtctctacacgaccggtgctcgatttagtacgtcatcaggctccagggaaggggctggagtgggtctcagtgatttatagtagttccagttcatttcacgcagactccgtgaagggccgattcaccatctccagagacatttccaagaacacggtggatcttcagatggacagcctcagagcggaggacacggctgtctattactgtgtgagaggcgccaccgtggggatggaaacgatttttcttgtttgtctgggccagggaaccctggtcaccgtctcctcagcctccaccaagggcccatcggtcttccccctggcgcctgctccaggagcacctccgagagcacagcggccctgggctgcctggtcaaggactacttcctagagacacg

SEQ ID NO: 533525 - DNA, 501 bp, Homo sapiens
  misc_feature: HEFZJCU01CWU9I.40.81.H04.1.454.heavy.3.raw
tctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcgagggtcaccatgacctgggacgcgtccatcagcacagtctacatggatctgagcggactgacctctgacgacacggccatgtattactggtgaaggagacgttgggtggctaccggcggggctcg

SEQ ID NO: 533526 - DNA, 509 bp, Homo sapiens
  misc_feature: HEFZJCU01CZPNX.22.70.G04.1.454.heavy.3.raw
acatacgcgtcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactgggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccaggctgttaaaactcctactacggtctggacgtctggggcc

SEQ ID NO: 533527 - DNA, 515 bp, Homo sapiens
  misc_feature: HEFZJCU01A8913.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtcccgtgagactctcctgtgtagtctctggaatcagtttcagtaccttctggatgcactgggtctgccaaactccaggtaaggggctggtgtgggtctcacgtatcaatcctgatggcagtgtataaattatgcggactccgtgaggggccgattcagcatctccagagacaacggcaagagtatactgtatctggaaatgaaacaatctgagaggtcgacgagtacggctgtctatctattgtgttttcgatcgccttcggtccgcgggtaccttgtcggggcctaac

SEQ ID NO: 533528 - DNA, 512 bp, Homo sapiens
  misc_feature: HEFZJCU01CE0QR.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaagggctggagtggatctcagggattagtggcactgggcgattatacatattatacagactccgtgaagggccgcttcaccatctccagagacaattccaagaacacggtgtaatctgcgaaatgaacagcctgagagccgaggaccacggaccacatattactgtgcgaaagatctcgggctggtccgcggtaccgggt

SEQ ID NO: 533529 - DNA, 501 bp, Homo sapiens
  misc_feature: HEFZJCU01B232K.7.76.G10.1.454.heavy.3.raw
cgtgtctctacacgaccggtgctcgatttagtcactcatacagggagaggctcttctgtgtgtagtggtttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaatgaacagcctgagaattgaggactcgggtatatactactgtgcccgtcgacccctgactgataaaccggactggttccgaccctcggggccagggaacctggtcaccgtctccta

SEQ ID NO: 533530 - DNA, 496 bp, Homo sapiens
  misc_feature: HEFZJCU01BHZNP.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgtacgacacggccatgtattactgtggaagagacgttggtggctaccgcggggtctgaccacgt

SEQ ID NO: 533531 - DNA, 535 bp, Homo sapiens
  misc_feature: HEFZJCU01AVEHX.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatggggtctcagttattcataccgacggtaccatatatgacgcagactccgtgaagggccgattcaccatcctccagagaccattccaagaacaccctataatcttcaaatgaacaacctgagagtcgaaagacacggccgtatattactgtgcgagacgatgacttcggtgaccccgtgggggccaggggaaccctgggtccaccgtcctcctcagtcccg

SEQ ID NO: 533532 - DNA, 432 bp, Homo sapiens
  misc_feature: HEFZJCU01B6R26.15.55.E11.1.454.heavy.3.raw
tctacgtagccacgaccggtgctcgatttagcactcgcacgttgggtttgggctcaactctcttgtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaagggcccatcggtcttccccctggcaccctcctccaagagcacctctgggggcacagcggccctgggctgcctggtcaaggactacttccgctacgtaga

SEQ ID NO: 533533 - DNA, 521 bp, Homo sapiens
  misc_feature: HEFZJCU01C3MVF.2.81.H04.1.454.heavy.3.raw
  modified_base (517)..(517): a, c, t, g, unknown or other
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggaaggggctggagtgggtggccaacatagagtacgatggaagtgagaaaaactatgtggactccgtgaagggccgattcaccatctccagagacaacgacaagaatttagtgtatctgcaaatgagcagcctgagagccgaggacacggctgtgtattattgtncgag

SEQ ID NO: 533534 - DNA, 400 bp, Homo sapiens
  misc_feature: HEFZJCU01DPYYA.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctctgggggcacgagcggccctgggctgcctggtcaagactacttcctacgtgagct

SEQ ID NO: 533535 - DNA, 534 bp, Homo sapiens
  misc_feature: HEFZJCU01A6RZ7.13.65.F10.1.454.heavy.3.raw
tcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttggggcgcggactcctcttgagatcgtggggcccgagggggaccaagtcgggttacaccgtcttcctttcagt

SEQ ID NO: 533536 - DNA, 498 bp, Homo sapiens
  misc_feature: HEFZJCU01A4USL.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggagtcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactgggg

SEQ ID NO: 533537 - DNA, 520 bp, Homo sapiens; identical to SEQ ID NO: 458346
  misc_feature: HEFZJCU01BOF5J.3.82.H05.1.454.heavy.3.raw

SEQ ID NO: 533538 - DNA, 513 bp, Homo sapiens
  misc_feature: HEFZJCU01BM8YE.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatgggcgaacccgtaacactggtgtcacagtgtcttcacccatcctccgggacagacttaccatgaccacgaactcctccataaacacagcctacatggagttgaggagcctgacatctgacgacacggccgtctattactgtgacgagagtcccacgatccggtgagcctacgggcacggcggtcctttggactttcgtc

SEQ ID NO: 533539 - DNA, 494 bp, Homo sapiens
  misc_feature: HEFZJCU01CE46Q.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttcccctggccaccctcctccaagagcacctctgggggcacagccggccctgggctgccgtggtcaaggactacttccgtatctctcg

SEQ ID NO: 533540 - DNA, 490 bp, Homo sapiens
  misc_feature: HEFZJCU01A8699.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacacgcctacagtaggacctggagcggccttggacagtcgtgacgacgacggccgtatattcgtgtgcgtaggga

SEQ ID NO: 533541 - DNA, 534 bp, Homo sapiens
  misc_feature: HEFZJCU01ASIYA.17.28.C06.1.454.heavy.3.raw
  modified_base (445)..(445): a, c, t, g, unknown or other
cgtagactagcacgaccggtgctcgatttagagctcacgtattgggtttggggctcagagaggaggcttagccctggactccaaggcctttccacttggtgatcagcactgagcacataggactcaccatggagttggggctgaactgggttttccttgttgctgttttagaaggtgttcagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagtttacgtggactctgtgaagggccgtttcaccatctccagagacaacgccaagaattcactgtatctacaactgaacagcctgagngtcgcagacacggccgtgtattactgtgcgagatgtaggaaaaagtataggctgtgtttattggggccaggggagccctggtcaccggt

SEQ ID NO: 533542 - DNA, 534 bp, Homo sapiens
  misc_feature: HEFZJCU01BBPJ9.10.34.D01.1.454.heavy.3.raw
catagtagtgcacgaccggtgctcgatttagatcgtctgtggttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaagggctggagtgggttggccatagttaaatcaaagctgatggtgggacaacagagcacgctgcacccgtgaaaggcagattcagcatctcaagagatgattacaaaaagtacgctgtatctagaacatgaacagcctagaaaacggaggaacacgagccgtgtattactgtcgacctactacgtacggaccgtatagtttcgttacgtagtaagtcgggtacg

SEQ ID NO: 533543 - DNA, 365 bp, Homo sapiens
  misc_feature: HEFZJCU01AYWAX.13.28.C06.1.454.heavy.3.raw
  modified_base (328)..(328): a, c, t, g, unknown or other
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctatttagaaggtgtccagtgtgaagtgcacctggtggagtccgggggagacttggtccagcctggggggtccctgagactctccgtgtgtagcctcgtggtatttgtttttagtgactattaggtatgagttgggtccgtccgaggcctccagggaaggggngtccccggaggtgggtggccgaacaataaacgtacga

SEQ ID NO: 533544 - DNA, 511 bp, Homo sapiens
  misc_feature: HEFZJCU01C6WH3.48.48.E04.1.454.heavy.3.raw
agtatacatacacgaccggtgctcgatttagagagcgtcacagagagaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaacgtcgaggcaccatatccgtagacacgtccaagaaccaattcctccctgaagctgagctctgtgaccgccgcagacacggctgtctattactgtgcgaggccccgagcgcagtgcgttttgtatgtcctttgtatatggtggggtccgaagggaccaagtggtaccg

SEQ ID NO: 533545 - DNA, 565 bp, Homo sapiens
  misc_feature: HEFZJCU01EARRL.40.31.C09.1.454.heavy.3.raw
tctagcgactcacgaccggtgctcgatttagacgtctcatcaaggaaggaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagccgcagtgggtcctttttgtagttcgtccttttgtacttaatggttggggggccgtaacgggggaacgtaaagttgggttaccgtaccgttccgttcctttacgtacggtccctaccctaacccgtaaacc

SEQ ID NO: 533546 - DNA, 510 bp, Homo sapiens
  misc_feature: HEFZJCU01A18GC.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctggggggaggcttggcacagcctgggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgacgaaagcaccggcagtttagtccacccatactacttttgactacgt

SEQ ID NO: 533547 - DNA, 383 bp, Homo sapiens
  misc_feature: HEFZJCU01BR2A6.11.61.F06.1.454.heavy.3.raw
  modified_base (309)..(309): a, c, t, g, unknown or other
cgagagataccacgaccggtgctcgatttagctacgctctaagggaaggggctggtgtgggtctcacgtattgacaatgatgggagtgacacaatccacgcggattctgtgaagggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggcnccctgctccaggagcacctccgagagcacagcggccctgggctgcctggtcaaggactacttccgtatctctcg

SEQ ID NO: 533548 - DNA, 515 bp, Homo sapiens
  misc_feature: HEFZJCU01BB50H.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacgggctatgtattactgtgcgagagatgagagtggctacagttggggccggggaaccctggtcaccgtcaa

SEQ ID NO: 533549 - DNA, 400 bp, Homo sapiens; identical to SEQ ID NO: 444452
  misc_feature: HEFZJCU01EZ73S.47.24.C02.1.454.heavy.3.raw

SEQ ID NO: 533550 - DNA, 535 bp, Homo sapiens
  misc_feature: HEFZJCU01A0J5E.53.78.H01.1.454.heavy.3.raw
cgcgtatacacacgaccggtgctcgatttagtgtgagtagtttgggtttggggacataacaaccagattcctcctctaaagaagcccctgggagcacagctcatcaccatggactggacctggaggttcctctttgtggtggcagcagttacaggtgtccagtcccaggtccagttggtgcagtctggggctgagttgaagaagccggggtcctcggtgaaggtctcctgcaagtattctggaggcaccttcaacaactatggtatcagctgggtgcgacaggcccctggacaagggcttgagtggatgggaagggtcacccctatttttgatgaagcagactctgcacagaagttccagggcagattaacgattacggcggacaagtccacggactaccgcctacatggagctgaccagtctgaaatctgaggacacggccctttattactgtgcgagatataccgtgggggttacgcggagatatcgccattactacttcgactactggggccaggggaaccctgatctaccg

SEQ ID NO: 533551 - DNA, 511 bp, Homo sapiens
  misc_feature: HEFZJCU01EALHI.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgagggagcctgacatctgacgacacggccgtctattactgtgcgagagtcccacgatccggtgagcctacggcagcggcctttgacttctggggccaggggacg

SEQ ID NO: 533552 - DNA, 551 bp, Homo sapiens
  misc_feature: HEFZJCU01DUEQA.53.78.H01.1.454.heavy.3.raw
cgcgtatacacacgaccggtgctcgatttagtgtgagtagtttgggtttgggctcaactcccaggtccagttggtgcagtctggggctgagttgaagaagcctgggtcctcggtgaaggtctcctgcaagtattctggaggcaccttcaacaactatggtatcagctgggtgcgacaggcccctggacaagggcttgagtggatgggaagggtcacccctatttttgatgaagcagactctgcacagaagttccagggcagattaacgattacggcggacaagtccacgactaccgcctacatggagctgaccagtctgaaatctgaggacacggccctttattactgtgcgagatataccgtgggggttacggcggagatatcgccatactacttcgactactggggccagggaaccctgatcaccgtctcctcagcctccaccaagggcccatcggtcttccccctcggccaccctccctccagagcacctctcggggggcacacgcggcccctcggggtctgccgtggtcgaaggaactactttcccg

SEQ ID NO: 533553 - DNA, 533 bp, Homo sapiens
  misc_feature: HEFZJCU01D3ATL.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattggggtataattattacagtgggaccaccaactacaacccctccctcaagagtcgagtcaccatatcaatagacacgtcgaagaaccagttctccctgaagttgaactcagtgaccgctgcggacacggaccgtgtattactgtgcgagccacaccgattacgatttttggagtggccttgataacgtggggccgaggggactcctcggtcaccgtctcctcgagcctccaccgaac

SEQ ID NO: 533554 - DNA, 396 bp, Homo sapiens; identical to SEQ ID NO: 444469
  misc_feature: HEFZJCU01DVDV1.47.46.E02.1.454.heavy.3.raw

SEQ ID NO: 533555 - DNA, 392 bp, Homo sapiens
  misc_feature: HEFZJCU01A9XOM.40.41.D08.1.454.heavy.3.raw
tctagcgactcacgaccggtgctcgatttagtcacgcgagaaagggaaaggggctggagtgggttggccgtgttaagaccaaacctgagggtggggcaatagactacgctgcacccgtgacaggcagattcgccatctcaagagatgattcagcaggcacggtgtatctggaaatgaacagcctgaaagccgaggacacagccgtgtattattgtaccgcagggctcggctactccgatactgactattggggccaggggaaccctggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 533556 - DNA, 480 bp, Homo sapiens
  misc_feature: HEFZJCU01DYW55.51.80.H03.1.454.heavy.3.raw
cgatcgtatacacgaccggtgctcgatttagctgtgcgtcgaagggaaagggggcagagcctgctgaattctggctgaccagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaaccagacacatccaagaaccagttctcctgcaactgaactctgtgactccgaggacacggccgtagtattactgtcgcaaggaggtttggtaaac

SEQ ID NO: 533557 - DNA, 508 bp, Homo sapiens
  misc_feature: HEFZJCU01A626I.11.71.G05.1.454.heavy.3.raw
cgagagataccacgaccggtgctcgatttagtgtcgtcgcaagagagagggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacaggccctgagagctggaggacacggctgtgtattactgtgtcgaaagtatttactaatagaggtgacgtacc

SEQ ID NO: 533558 - DNA, 552 bp, Homo sapiens
  misc_feature: HEFZJCU01CAKSO.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctggagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattccaagaacacggtgaatcttcaaatgaacagcctgagaaccgaggacacggccgtatattattagtattaggttatgggtggtaaattcggggcccctggggcctaggggaaccgtggtcaccgtctcctcgagcctccaccg

SEQ ID NO: 533559 - DNA, 529 bp, Homo sapiens
  misc_feature: HEFZJCU01DF4J2.12.86.H09.1.454.heavy.3.raw
  modified_base (482)..(482): a, c, t, g, unknown or other
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaacctggtgaccgtctcctcagcctccaccaagggcccagtcgtcttcccctggcnccctgctccagagcacctccgagacgcacgcgacggccctcgggtcg

SEQ ID NO: 533560 - DNA, 495 bp, Homo sapiens
  misc_feature: HEFZJCU01C6L9D.48.23.C01.1.454.heavy.3.raw
  modified_base (486)..(486): a, c, t, g, unknown or other
agtatacatacacgaccggtgctcgatttagtacacgtgattagggattggggacccaacaaccacatccctcctcagaagcccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggcccccggacaaagccttgagtggatggggcggctcaacgctggcgatggtcagacaaagtattcacagaagttccagggcagagtcaccatcaccgagggacacgtccgcgagtagtgtcttcatggagctgcgcagtctgagatcggaagacacggcagtatattactgtgcgagaggcggatattgtcgtcgaggtgactgctanagtacaaat

SEQ ID NO: 533561 - DNA, 527 bp, Homo sapiens
  misc_feature: HEFZJCU01DG6CZ.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcctgtgcagcctctgggttcaccttcagtagctacggcatgcactggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacggaagggaaggggggaaccgtaggcggggagttccaaggtactcctttgacgttcgtggggcctacc

SEQ ID NO: 533562 - DNA, 514 bp, Homo sapiens
  misc_feature: HEFZJCU01BK6K4.49.11.A11.1.454.heavy.3.raw
agtcgagagacacgaccggtgctcgatttagctacgactgcagggggctctgggagaggagccccagccttgggattcccaagtgttttcattcagtgatcaggactgaacacagaggactcaccatggagtttgggctgacctggattttccttgctgctattttaaaaggtgtccagtgtcaggtccagctggtggagtctgggggaggcttggtaaggcctggggggtcccttagactctcctgtgcagcctctggattcaatttcaatgacgcctggatgagctgggtccgacaggctccagggaaggggctggagtgggttgcccgtattaaaagcagagttgatggtgggacaagagagtacgctgcgaccgtgaaaggcagagtcagcatctcaagagatgattcaagagacacggtgtttctgcaattgaccagcctgaaaacggaggacacagccgtgtattactgtgccacgtggccaccagtcggataccgccttattcttac

SEQ ID NO: 533563 - DNA, 520 bp, Homo sapiens
  misc_feature: HEFZJCU01BEMWN.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaagggctggagtgggttggccgttctagagacacaactaacagtgacaccgcacaatacgccgcgtctgtgaaaggcagattcaccatctcaagagatgattcaagagaactcacctttatctgcaaatgaaacagcctgagaaccgacgacacggccgtctattattgtgtcatagacctaggatacaacgacggtggtacctggtattc

SEQ ID NO: 533564 - DNA, 492 bp, Homo sapiens
  misc_feature: HEFZJCU01EOKFA.10.55.E11.1.454.heavy.3.raw
catagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcaggagtctccatgaccagtgacacgtccgcgagcactgtctatatggagatgaggagcctgagacttgacgacacggccgtatattactgtgcgagaatcgaagaaggtggctacaactcaac

SEQ ID NO: 533565 - DNA, 506 bp, Homo sapiens
  misc_feature: HEFZJCU01CRVJ5.40.31.C09.1.454.heavy.3.raw
tctagcgactcacgaccggtgctcgatttagacgtctcatcaaggaaggaaggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctacaaaagtcgaggcaccatatccgtagacacgtccaagaaccaattcctcctgaagctgagctctgtgaccgccgcagacacggctgtctattactgtgcgacggcccgagcgcagtggtcttttgtatgtccttcgtatatggtggggccgaagggacaagtaggtcgtaccgtctcctt

SEQ ID NO: 533566 - DNA, 502 bp, Homo sapiens
  misc_feature: HEFZJCU01DV08G.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatggttggcagatatacaatatgatgacagtaaaatatactaatggagactccttcaagggccgattcaccatctccagagacaattccaagaacatggtgtatctgtcaaatgaccaggcctgagagccgaggacacgggtgttttattacgtgtgggagtaaatcctagtggcta

SEQ ID NO: 533567 - DNA, 489 bp, Homo sapiens; identical to SEQ ID NO: 447707
  misc_feature: HEFZJCU01EJ1XX.10.55.E11.1.454.heavy.3.raw

SEQ ID NO: 533568 - DNA, 526 bp, Homo sapiens
  misc_feature: HEFZJCU01CP4GG.14.76.G10.1.454.heavy.3.raw
cgtctagtaccacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacggaaccgttaactacgctatggacgtcgtgggggccaagggacccg

SEQ ID NO: 533569 - DNA, 534 bp, Homo sapiens
  misc_feature: HEFZJCU01EX6C6.7.78.H01.1.454.heavy.3.raw
  modified_base (439)..(439): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaacccccacctatgcccaggccttcacagggcggtttgtcttctccatggatacctctgtcgggacggcttatctgcagataaccaaccttcaacctgacgacactnccgttttatttttgtacgagagcgtcgtctgtcagtggaattgactactggggccagggaccctggtccaccgtctcctcagcctccaccacggg

SEQ ID NO: 533570 - DNA, 512 bp, Homo sapiens
  misc_feature: HEFZJCU01A8RI2.22.86.H09.1.454.heavy.3.raw
acatacgcgtcacgaccggtgctcgatttagtgctatagacttggggtttggggctgagctgggttttcctcgttgctcttttaagaggtgttcagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggacgaggacacggcagtgtattactgtgcgagagatcgacatgactacgggaaagcttttgatctctggggccaagggacactggtcaccgtctcttcagcctccaccaagggcccatcggtccttcccctggcgccctgcctccaggacg

SEQ ID NO: 533571 - DNA, 501 bp, Homo sapiens
  misc_feature: HEFZJCU01D6TC6.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggccccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggtacacggccattttattactgtgcaaggaacagcataatgactcgtcccccggactttcg

SEQ ID NO: 533572 - DNA, 491 bp, Homo sapiens
  misc_feature: HEFZJCU01D8A43.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatacaacgtagacaacatcgaagaaccagttctccctgcagctgacctctgtgactcccgaggacacgggtgtatattactcgtggaaggacggccccgactagacatgcccacctcgtctctggtgctt

SEQ ID NO: 533573 - DNA, 510 bp, Homo sapiens
  misc_feature: HEFZJCU01CJSEG.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccgagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgtagtttggtttgggcggggtataggccaggcggtaccc

SEQ ID NO: 533574 - DNA, 525 bp, Homo sapiens
  misc_feature: HEFZJCU01CNXQW.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaacgggcccactcggtcttccccctggcaccctcctccaagagcacctctgggggcacagcggcccgtgggctgcctggtcaaggactacttccgaggtagtactcg

SEQ ID NO: 533575 - DNA, 502 bp, Homo sapiens
  misc_feature: HEFZJCU01EUTHB.26.23.C01.1.454.heavy.3.raw
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccggcctttgaccactggggccagggaacccctggtcaccgtctcctcagcctccaccaagggcccatcggtcttcccctggcgccctgctccaggagcacctccgagagcacagcggccctgggctgcctggtcaaggactacttccagtatagtct

SEQ ID NO: 533576 - DNA, 526 bp, Homo sapiens
  misc_feature: HEFZJCU01AHBN1.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtcctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacggacgtgtatttttgtgtgaaagatacgaagtctatgataccctaatttgggaggggcctttcatgtctc

SEQ ID NO: 533577 - DNA, 400 bp, Homo sapiens; identical to SEQ ID NO: 444452
  misc_feature: HEFZJCU01DY8Q7.47.24.C02.1.454.heavy.3.raw

SEQ ID NO: 533578 - DNA, 548 bp, Homo sapiens
  misc_feature: HEFZJCU01ESHZO.51.30.C08.1.454.heavy.3.raw
cgatcgtatacacgaccggtgctcgatttagtctgacgtcaaagggaaaggggtctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctgggagtggggtggcaacttatctcatctgatggaaggtctgaatcttatgccgactccgtgaagggccgattcaccatcctcagagacaattccaagaatacactatatcttactaaactgtaaacaacgtcttaggagacggttaggaaaggaacaaccgggcttggttcttaatttaacctgtggaccgacgttaggacgtaagttggttcttttagtttaaaccg

SEQ ID NO: 533579 - DNA, 488 bp, Homo sapiens
  misc_feature: HEFZJCU01DGMGV.49.86.H09.1.454.heavy.3.raw
  modified_base (440)..(440): a, c, t, g, unknown or other
agtcgagagacacgaccggtgctcgatttagtgctatagacttgggtttggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctggggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatagtagactccgtgaagggccgattcatcatctccagagacaactccgagaacacgctgtatctgcaaatgaanaggctgagagctgaagacacggctagtatattactgtgcgtaacttaa

SEQ ID NO: 533580 - DNA, 501 bp, Homo sapiens
  misc_feature: HEFZJCU01BYMIM.18.33.C11.1.454.heavy.3.raw
  modified_base (442)..(442): a, c, t, g, unknown or other
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcaggccctgcattcatctttaatagttattggatgcactgggtccgccaggctccggggaaggggccggagtgggtggccaacataatgcaagatggaactgagaagaactatgtggactctgtagaagggccgattcaccatctccagagacaacactaagaacttactgtatctgcaaatgaacagcctnagagccgaggacgacggctgtgtattactgtgcgaagagcagtggcgtgggacagtcgg

SEQ ID NO: 533581 - DNA, 523 bp, Homo sapiens
  misc_feature: HEFZJCU01A06S0.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaagggggctggaatggatttcatacattagcagtagtggtgcgaccatatactacgcagactctgtgaagggccgattcatcatctccagagacaatggcaacaactcactgtactctaggaatacaacgacgacctagacgtagtcggaggaccgacggctggtaatatttattggtcgtcgagtacgacccccgttacggtcgtacc

SEQ ID NO: 533582 - DNA, 513 bp, Homo sapiens
  misc_feature: HEFZJCU01CVAYL.17.25.C03.1.454.heavy.3.raw
cgtagactagcacgaccggtgctcgatttagtagtgtagatttgggtttggggaaccacatctgtcctctagagaaaaccctgtgagcacagctccctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacacgcctacatggagttgaggagcctgacatctgacgacacggccgtctattactgtgcgagacgtcccacgatccggtgagcctacggcagcggcctttgacttcgtggggccaggggacg

SEQ ID NO: 533583 - DNA, 505 bp, Homo sapiens
  misc_feature: HEFZJCU01AX56W.40.55.E11.1.454.heavy.3.raw
  modified_base (454)..(454): a, c, t, g, unknown or other
tctagcgactcacgaccggtgctcgatttagcactcgcacgttgggtttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacacgtgggagcaccgtactacaacccgtccctcaaaagtcgaggcaccatatccgtagacacgtccaagaaccaattctccctgaagctgagctctgtgaccgccgcagacacggctgtctatactgtgcgacggccccgagcgnagtggtcgttttggtatcgtcctttcgattatggtggggccgaaaggggac

SEQ ID NO: 533584 - DNA, 541 bp, Homo sapiens
  misc_feature: HEFZJCU01EOWU3.17.28.C06.1.454.heavy.3.raw
  modified_base (371)..(371): a, c, t, g, unknown or other
  modified_base (455)..(455): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgnggactctgtgaagggccgtttcaccatctccagagacaacgccaagaattcactgtatctacaactgaacagcctgagagtcgnagacacggccgtgattactgtgcgagatgtggaaaaagtagtaggctgtgttttagttggggccaggggagccctgggtcctaccg

SEQ ID NO: 533585 - DNA, 494 bp, Homo sapiens
  misc_feature: HEFZJCU01BYMKD.12.75.G09.1.454.heavy.3.raw
  modified_base (434)..(434): a, c, t, g, unknown or other
  modified_base (484)..(484): a, c, t, g, unknown or other
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaacttccaggacagagtccacgattaccgcggacgaatccacgaccacagcctacatagagctgcgcagcctgagatctagaanacgacggccattttattactgtggcgagagatgcacgggccctcccaacntacggtttta

SEQ ID NO: 533586 - DNA, 336 bp, Homo sapiens
  misc_feature: HEFZJCU01DPY1T.52.66.F11.1.454.heavy.3.raw
cgcagtacgacacgaccggtgctcgatttagtcacgcgagaagggccggtgcaccatctccagagacaattcgaaggacactctatacctgcaactcaacagactgacacccgcggacacggccgtctattactgtgtaaaagaagacggaccgctggacgaggagccagaggagaatcactactttgactactggggccagggaagactggtcaccgtctcctccgcctccaccaagggcccatcggtcttccccctggcaccctcctccaagagcacctctgggggcacagcggccctgggctgcctggtcaaggactacttcctatacgatcg

SEQ ID NO: 533587 - DNA, 521 bp, Homo sapiens
  misc_feature: HEFZJCU01C14DR.51.9.A09.1.454.heavy.3.raw
cgatcgtatacacgaccggtgctcgatttagcgagacgcgcagggggccttagccctggattccaaggcatttccacttggtgatcagcactgaacatagaggactcaccatggagttgggactgtgctgggttttccttgttgctattttagaaggtgtccagtgtgaggtgcggctggtggagtctgggggaggcttggtacagcctggggggtccctgacactctcctgtgcagcctctggattccccttcagaacttatgaaatgaactgggtccgacaggctccagggaaggggctggagtgggtttcacacattagtagtggtggaagtaccatattctacgcagactttgtgcagggccattcaccatctccagagacgacgccaagaattcactgtatctgaaatgaacagcctgagagccgacgacacggctgtttattactgtgcgagagattactatctatagtagttggtttttttccctacttactccggtatggacgtcgtggggcc

SEQ ID NO: 533588 - DNA, 518 bp, Homo sapiens
  misc_feature: HEFZJCU01C36MH.48.81.H04.1.454.heavy.3.raw
  modified_base (403)..(403): a, c, t, g, unknown or other
agtatacatacacgaccggtgctcgatttagtagtgtagattcgcgggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgnagttggacctgagcggacctgagacctgaggacacggccaatttactactgtgcgtcggggaggtggacggagcttcgggttttcggagtttatcatctacttactttgaacttc

SEQ ID NO: 533589 - DNA, 501 bp, Homo sapiens
  misc_feature: HEFZJCU01CJ77C.49.9.A09.1.454.heavy.3.raw
agtcgagagacacgaccggtgctcgatttagcgagacgcgcaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtgacttttatttcatatgatcgaagtaataaatactatgcagactccgtgaagggccgattcaccatctcagagacaattccaagaacacgctgtatctgcaaatgaacagcctgagacctgaggacacggcttgtttatttctggtgacgaacttaatcacggagacaacggtccg

SEQ ID NO: 533590 - DNA, 500 bp, Homo sapiens
  misc_feature: HEFZJCU01AEM05.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgcctgctccaggacgcacctccgagagcacagcggcccgtgggctgcctggcaaggactactcctatgtatact

SEQ ID NO: 533591 - DNA, 514 bp, Homo sapiens; identical to SEQ ID NO: 490286
  misc_feature: HEFZJCU01ADKCT.3.34.D01.1.454.heavy.3.raw

SEQ ID NO: 533592 - DNA, 515 bp, Homo sapiens
  misc_feature: HEFZJCU01DG9Y3.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagtccttactattactgtgttaggggtagttttacgtatttttgggt

SEQ ID NO: 533593 - DNA, 563 bp, Homo sapiens
  misc_feature: HEFZJCU01DOKOB.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagaggacacacgaacctactggccaatactatgggggcttggttcgtgggggccgacgggggacccgtcgggtctatcggttcctcccccagccctaccacccgaacgggaccccagtccggtccgtttcccccctcgggtcccgcccgtccg

SEQ ID NO: 533594 - DNA, 504 bp, Homo sapiens
  misc_feature: HEFZJCU01ENV23.53.81.H04.1.454.heavy.3.raw
cgcgtatacacacgaccggtgctcgatttagtagtgtagattcgcgggggctctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtggggtggcagttatatcatttgatggaagcaactacatactacgcaactccgtgaaggccgattcaccatctccagagacgattccaggaacactctgtttctccaaatgaacagcctgagagctgaggacacggctctttattactgtgcgagagattctggatacacgaccatttaacg

SEQ ID NO: 533595 - DNA, 533 bp, Homo sapiens
  misc_feature: HEFZJCU01DIEAQ.52.29.C07.1.454.heavy.3.raw
cgcagtacgacacgaccggtgctcgatttagagtgctacgaagggaaagggggctctgggagacgagcccagcactggaagtcgccggtgtttccattcggtgatcatcactgaacacagaggactcaccatggaatttgggctgacttgggttttcctcgttgctcttttaagaggtgtccagtgtcaggtgcaactggtggagtctgggggaggcgtggtccagcctgggaggtccctgagactctcctgtgtcgcctctggattcaccttcagtatttatggcatttattgggtccgtcaggctccaggcaaggggctggaatgggtggcctttatttcatatgatggaaccaataaagcctacactgactccgtgaagggccgattcaccatctccgagacaattccaagacacactctatctgcaaatgaacagcctgagacatgaggacacggctgtttactcttgtgcgagtaattgcccttcgtttacgggggtccctttgacaactggggccagggaacccttc

SEQ ID NO: 533596 - DNA, 492 bp, Homo sapiens
  misc_feature: HEFZJCU01EK5IS.49.17.B06.1.454.heavy.3.raw
agtcgagagacacgaccggtgctcgatttagtcgatagtgaaggggtctgggagacgagcccagcactggaagtcgccggtgtttccattcggtgatcatcactgaacacagaggactcaccatggagtttgggctgagctgggttttcctcgttgctcttttcagaggtgtccagtgttatgtgcagctggtggagtctgggggaggcgtggtccagcctgggaggtccctgagactcgcctgcaaaccgtccggattcaccttcagtaattatgcaatgcactgggtccgccagactccaggcaaggggctgcactgggtggcggccatatcatttgatggaagcaagaaatactatgcagactccgtgaggggccgattcaccatctccagagacagttccgatgacacagtgtatctgcaaatgaacagcctgagacctaggaggacacggctctctttactgtgcgccaggaagcagtggctggccg

SEQ ID NO: 533597 - DNA, 503 bp, Homo sapiens
  misc_feature: HEFZJCU01EQQ09.49.81.H04.1.454.heavy.3.raw
agtcgagagacacgaccggtgctcgatttagtagtgtagattcgcgggcacgaccggtgctcgatttagtagtgtagattcgcggggtctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctggggggagccttggttcagcctggagggtccctgagactctcctgtgcagcctctggattcagcttcagtagttatgagatgaactgggtccgccaggctccagggaaggactggagtgggtttcatacattagtcggagagtcaacaccgtattctacacagactctgtgaggggccgattcaccatctccagagacaacgccaagaactcactgtatctccaaatgaacagcctgagagtcgaaggacacggctgtctta

SEQ ID NO: 533598 - DNA, 492 bp, Homo sapiens
  misc_feature: HEFZJCU01CMVDD.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaaggactacttcctacgtgagctctg

SEQ ID NO: 533599 - DNA, 501 bp, Homo sapiens
  misc_feature: HEFZJCU01EGCW6.11.16.B05.1.454.heavy.3.raw
cgagagataccacgaccggtgctcgatttagagctcacgtattgagctctgggagaagagccccagccccagaattccgaggagtttccattcggtgatcagcactgaacacagaggactcaccatggagtttgggctgagctgggttttccttgttgctattatagaaggtgtccagtgtcaggtgcaactggtggaatctgggggaggcttggtcaagcctggggagtccctgagactctcctgtgcagcctctggattctccttcagtgactcctttatgagttggatccgccaggctccagggcaggggctggaatggatttcatacattggtgaaagtggcagtcccatataccacgcagactctgtgaagggccgggttcaccatctccagggacaactccaaaaactcactatatctggaaatgactagcctgagactcgaggacacggccgtttattactgtgcgacgcccgccgatagcagcatcatctacg

SEQ ID NO: 533600 - DNA, 482 bp, Homo sapiens
  misc_feature: HEFZJCU01ECSCZ.49.42.D09.1.454.heavy.3.raw
  modified_base (477)..(477): a, c, t, g, unknown or other
agtcgagagacacgaccggtgctcgatttagacacatacgcagggaaagggggctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatactgcaaatgaacaggctgagagctgaagaccaggctttatattactgtncgact

SEQ ID NO: 533601 - DNA, 313 bp, Homo sapiens; identical to SEQ ID NO: 444518
  misc_feature: HEFZJCU01AKLDH.7.10.A10.1.454.heavy.3.raw

SEQ ID NO: 533602 - DNA, 533 bp, Homo sapiens
  misc_feature: HEFZJCU01DHH3W.17.28.C06.1.454.heavy.3.raw
cgtagactagcacgaccggtgctcgatttagagctcacgtattgggtttggggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtaatggactgtgtttattggggccagggagccctggtccaccgttctcctca

SEQ ID NO: 533603 - DNA, 533 bp, Homo sapiens
  misc_feature: HEFZJCU01BUXO6.12.40.D07.1.454.heavy.3.raw
atacgacgtacacgaccggtgctcgatttagtgatagagcgtaacaacagagggctcaccatggagtttgggctgagctgggtttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccttgagggggccgattcaccatctccagagacaattacaagaacaccctttatcttcaaatagacagcctgagaccagacgacacggctgtctattattgcgcgagagagacacacgaacctactggccaatactaatgggggcttgttctggggccagggggaccctgggtcatcgtctccccagcctccaccaacgggcccatcggtcttcccctcggcgccctg

SEQ ID NO: 533604 - DNA, 491 bp, Homo sapiens
  misc_feature: HEFZJCU01C4ELP.49.58.F03.1.454.heavy.3.raw
  modified_base (393)..(393): a, c, t, g, unknown or other
agtcgagagacacgaccggtgctcgatttagtctgatcgagaagggaaagggggggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggcctccaggcaagggggctggagtgggtggcatttatatcatatgatggaagcaagatatactatgtagactccgtgaagggccgattcatcntctccagagacaactccgagaacacgctgtatctgcaaatgaacaggctgagagctgaagacacggctttatattactgtgcgaacttaatcacggaa

SEQ ID NO: 533605 - DNA, 507 bp, Homo sapiens
  misc_feature: HEFZJCU01D7PK3.51.36.D03.1.454.heavy.3.raw
cgatcgtatacacgaccggtgctcgatttagctgcgtcacgatctctcttggggggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagccccccgggagggggctggattggattggcagtatcagttatactgggaccaccttcttcaagtcgtcgctcaagagtcgagtcaccatgaccgcggacacgtccaaggaccagttctccctgaagctgacctctgtgaccgccgcagacacggctttgtatttctgtgctagatataatgtgggtgacagtggtgcctactacggagcttttgatatttggggccaaggcacgaaggtcaccgtctcatcacg

SEQ ID NO: 533606 - DNA, 515 bp, Homo sapiens
  misc_feature: HEFZJCU01ANQ3J.19.86.H09.1.454.heavy.3.raw
  modified_base (491)..(491): a, c, t, g, unknown or other
tactctcgtgcacgaccggtgctcgatttagtgctatagacttgggtttgggggggaagaggaagactgacggccccactcccaggtgcagctggtgcagtctggggctgaggtgaaggagcctggggcctcagtgaaggtctcctgcgaggcttttggatacacctttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgagcaggacggggctaaggcataagtgttcgaccctgggccagggaaccctggtcaccgtctcctcagcctccaccaagggcccatcggtcttcccctcggcgccctcgctccaggancacctccgagagcacagcggcccg

SEQ ID NO: 533607 - DNA, 506 bp, Homo sapiens
  misc_feature: HEFZJCU01EYGMQ.13.85.H08.1.454.heavy.3.raw
  modified_base (424)..(424): a, c, t, g, unknown or other
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggccaaggtcttgagtggatggggactaatcactcccaatggtgatgggactgcctacgcacagaagtttcagggcagagtcaccatgaccagggacacgtccacgagaacagactatttggaggttgagacngacctgagatctgacgacacggccgtttattactgttgcgcgagataatagtcacaactggaacggcgttttggggtggttc

SEQ ID NO: 533608 - DNA, 522 bp, Homo sapiens
  misc_feature: HEFZJCU01A9P7G.4.57.F02.1.454.heavy.3.raw
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccacgggaaccctggtcaccgtctcctcagcttccaccaagggcccatcgtcttcccctggccgccctgctccacggagacgcctcgtcggggcgacgagccggtcccg

SEQ ID NO: 533609 - DNA, 515 bp, Homo sapiens
  misc_feature: HEFZJCU01BMXUE.4.33.C11.1.454.heavy.3.raw
agcactgtagcacgaccggtgctcgatttagagtgagctcgttgggtttggggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccgaacggcatcgcctatcttgcagatgaacagcctgaagaccgaggacacacgccgtctattacttgtgttagggtagttttacgtatttttggtagtgg

SEQ ID NO: 533610 - DNA, 484 bp, Homo sapiens
  misc_feature: HEFZJCU01EF6VY.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactgggggccagggaaccctcgtcaccgtctcctcagcctccaccaagggcccatcggtcttcccctcggcaccctcctccaagagcacctctgggggcacagcggccctgggctgcctggtcaaggactacttcctagagacacg

SEQ ID NO: 533611 - DNA, 521 bp, Homo sapiens
  misc_feature: HEFZJCU01DDP6C.17.25.C03.1.454.heavy.3.raw
cgtagactagcacgaccggtgctcgatttagtagtgtagatttgggtttggggactcaacaaccacatctgtcctctagagaaaaccctgtgagcacaactcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttggaggagcctgacatctgacgacacggccgtcgtattactgtgcgtagagtcccacgatccggtgacgcctacggcagccggccgtttgactttcgtgggggtacccg

SEQ ID NO: 533612 - DNA, 518 bp, Homo sapiens
  misc_feature: HEFZJCU01APURU.51.78.H01.1.454.heavy.3.raw
cgatcgtatacacgaccggtgctcgatttagtgtgagtagtttgggtttggggctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaaggcctggagtgggtctcacgtattagttggaatagtggtagtatagcctatgcggactctgtgaagggccgattcaccatctccagagacaacgccaagaactccctgtatctgcaaatgaacagtctgagagctgaggacaccggccgttagtattactgcgacaaaacgccaaagggccaaacgagaccgttgggtacctac

SEQ ID NO: 533613 - DNA, 534 bp, Homo sapiens
  misc_feature: HEFZJCU01B2LS2.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctccctgtgcagcctctggattcaccttcagcaattactggctgcactgggtccgccaagctccagggaaggggctggtgtgggtctcacatattaatctcgatgggagtaatttagacctacgcggactccgtcaagggccgattcaccgtctccagagacaacaccaagaacacactatatctgcagattgacagtctgagacccgaggacacggctgtgtattactgtgcaaggcaggttcgtggaaacagttatgggttggggggagttggggttttttttcgttacttacgggat

SEQ ID NO: 533614 - DNA, 506 bp, Homo sapiens
  misc_feature: HEFZJCU01EH4HT.17.25.C03.1.454.heavy.3.raw
  modified_base (480)..(480): a, c, t, g, unknown or other
cgtagactagcacgaccggtgctcgatttagtagtgtagatttgggtttggggaaccacatctgtcctctagagaaaaccctgtgagcacagctcctcaccatggactggacctggaggatcctctttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcngcggcctttgacttctggggccaggg

SEQ ID NO: 533615 - DNA, 534 bp, Homo sapiens
  misc_feature: HEFZJCU01EXN0D.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaacgctgacctttgtgactgccgcggacacggccgtgtattactgtgcgagagacccctcgatagcagtggctggtccactaggtttgacttacgtggggccaggggaacgtcgtttggtcaccggtctccctcacgcctcccg

SEQ ID NO: 533616 - DNA, 508 bp, Homo sapiens
  misc_feature: HEFZJCU01EHOU0.3.17.B06.1.454.heavy.3.raw
  modified_base (485)..(485): a, c, t, g, unknown or other
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcacttttatctgcaaatgaacagcctgagaaccgacgacacggccgtctattattgtntcatagacctaggatacaacgac

SEQ ID NO: 533617 - DNA, 511 bp, Homo sapiens
  misc_feature: HEFZJCU01AW2E1.10.38.D05.1.454.heavy.3.raw
  modified_base (480)..(480): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccgttcaccctctccagagacacttccaacaacatctttgtattcttcacatgcacaatctgagaggtcgacgacacggccacctattattgtgccgcgacangactacgctctaattctggggccaggggacg

SEQ ID NO: 533618 - DNA, 393 bp, Homo sapiens
  misc_feature: HEFZJCU01B983E.16.70.G04.1.454.heavy.3.raw
tgtactactccacgaccggtgctcgatttagtgtagtgtgaagggaaggggctggagtggatcgggaatatctattatagtgggagcacctactacaacccgtccctcaagagtcgagtcgccatatccgtagacacgtccaagaaccacttctccctgaaactgagctctgtgaccgccgcagacacggctgtctattactgtgcgagacagagttacgacggtggttactccggtctctttgacaactggggccagggaaccctggtcaccgtctcctcagcctccaccaagggcccatcggtcttccccctggcaccctcctccaagagcacctctgggggcacgagcggccctgggctgcctggtcaaggactacttccgagtagtaca

SEQ ID NO: 533619 - DNA, 522 bp, Homo sapiens
  misc_feature: HEFZJCU01E1FR0.53.33.C11.1.454.heavy.3.raw
cgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagttggtttggtaccgttccgaccccgtcggggccgagggaaccctggtcaccggtcctcctcagccttccaccaacgggcccatccggtccttccccctcggccgcccg

SEQ ID NO: 533620 - DNA, 346 bp, Homo sapiens; identical to SEQ ID NO: 517393
  misc_feature: HEFZJCU01BNSE8.52.78.H01.1.454.heavy.3.raw

SEQ ID NO: 533621 - DNA, 489 bp, Homo sapiens
  misc_feature: HEFZJCU01DFVO5.19.53.E09.1.454.heavy.3.raw
tactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaatgaacagtctagagagctgaggacaccggccttgtatactgtgcaggaggtat

SEQ ID NO: 533622 - DNA, 499 bp, Homo sapiens
  misc_feature: HEFZJCU01EIA6G.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagttgagcagcctgagatctgacgacacggccgtttatactgtgcgcgagataatagtcacaactggaacggcgttttggggtggttc

SEQ ID NO: 533623 - DNA, 535 bp, Homo sapiens
  misc_feature: HEFZJCU01DFPBU.49.59.F04.1.454.heavy.3.raw
agtcgagagacacgaccggtgctcgatttagtacacacacttagggattggggacacataacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatgggggaggatcatcccgtattgttgggtgtgacaaactacgccacagaagttccaggacagaatcaacgataaccgcggacacatccacgagcactatttcatggactgagcagcctcagatccgaggacacgggccgtttactacgtgtgcgagcgactcccgggattccccgcgtttcggaggagtagactacgtgggggccaggggaaccccgtcggtaccg

SEQ ID NO: 533624 - DNA, 400 bp, Homo sapiens
  misc_feature: HEFZJCU01DCZJ9.4.77.G11.1.454.heavy.3.raw
agcactgtagcacgaccggtgctcgatttagctagtcactcaagggaaggggctggaatggctttcatacattactagcagtggtacagcatactacgcagagtctctgcagggccgattcaccatctccagggacaacgccaagaactcgctatatctggaaatgaacagcctgagagtcgaggacacggccctgtattactgtgcgagagaccgaggaagggcagtggctggatccgttagggtttttgacaactggggacagggaaccctggtcaccgtctcctcggcctccaccaagggcccatcggtcttccccctggcggccctgctccaggagcacctccgagagcacagcggccctgggctgcctggtcaaggactacttccctacagtgct

SEQ ID NO: 533625 - DNA, 513 bp, Homo sapiens
  misc_feature: HEFZJCU01BS0HT.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgacggccctatcctacagtcgaccactccacgcctgggttcgaccgtctcggggccaac

SEQ ID NO: 533626 - DNA, 388 bp, Homo sapiens
  misc_feature: HEFZJCU01BRYEO.16.59.F04.1.454.heavy.3.raw
  modified_base (345)..(345): a, c, t, g, unknown or other
tgtactactccacgaccggtgctcgatttagtacacacacttagggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctggggcaagggaccacggtcaccgtctcctcaccctccaccaagggcccactcggtcttccccctcggcaccctcctccaagagcacctctgggggcacancggcctgggctgcctggtcaaggactacttccgacgtagtaca

SEQ ID NO: 533627 - DNA, 526 bp, Homo sapiens
  misc_feature: HEFZJCU01DLMBT.48.33.C11.1.454.heavy.3.raw
  modified_base (510)..(510): a, c, t, g, unknown or other
agtatacatacacgaccggtgctcgatttagagtgagctcgttgggtttggggggaagaggaagactgacggtccccccaggagttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggtttactatggttcggggagtcgtccgacccagcaactggttcgacccctggggccagggaaccctggtcaccgtctcctcagcctccaccgaaggcccatcggtcttccccgtcgcaccctcctccaagngcacctcgtggggcac

SEQ ID NO: 533628 - DNA, 476 bp, Homo sapiens
  misc_feature: HEFZJCU01BF91Q.49.8.A08.1.454.heavy.3.raw
  modified_base (293)..(293): a, c, t, g, unknown or other
  modified_base (450)..(450): a, c, t, g, unknown or other
  modified_base (467)..(467): a, c, t, g, unknown or other
agtcgagagacacgaccggtgctcgatttagcatactctacagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagggtctatgacatgcactgggtccnccaggctccaggcaaggggctggagtgggtggcagttatatcatatgatggaagcaatatatactatgtagactccgtgaagggccgattcatcatctccagagacaattccgagaacacgctgtatctgcaaatgaacagcctgagagctgagacncggctgtgtattactgngcgtaactt

SEQ ID NO: 533629 - DNA, 519 bp, Homo sapiens
  misc_feature: HEFZJCU01BXKUH.12.40.D07.1.454.heavy.3.raw
atacgacgtacacgaccggtgctcgatttagtgatagagcgtaacacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaaggcccatcggtctcccctcggcg

SEQ ID NO: 533630 - DNA, 532 bp, Homo sapiens
  misc_feature: HEFZJCU01E0EKT.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttagtggttggggggagtttggggtttttttacgttacgtacgggatc

SEQ ID NO: 533631 - DNA, 506 bp, Homo sapiens
  misc_feature: HEFZJCU01DVAVF.11.57.F02.1.454.heavy.3.raw
  modified_base (410)..(410): a, c, t, g, unknown or other
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatctccagagacaanggcaacaactcactgtatctggaaatcaacagcctgagagtcgaggacacggctgtatatttattgtgcgtaagacgcccccgtacggtcgtaccg

SEQ ID NO: 533632 - DNA, 505 bp, Homo sapiens
  misc_feature: HEFZJCU01EXZQ8.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagtttattagtccctactttgactactggggccagggactctggtcaccgtctccgcagcctccacc

SEQ ID NO: 533633 - DNA, 490 bp, Homo sapiens
  misc_feature: HEFZJCU01EAT2A.10.29.C07.1.454.heavy.3.raw
catagtagtgcacgaccggtgctcgatttagagtgctacgaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggaatccccttcagtacctatggcatgcactgggtccgccaggctccaggcaaggggctggagtgggtggcagccatatcgtatgatgtaactaataaatactatgcagactccgtgaagggccgattcaccatctccagagacaatttcaagaacacgctgtttctgcaaatgaacagcctgagagctgaggacacggctgtgtattactgtgcgaagatatcgcggtga

SEQ ID NO: 533634 - DNA, 522 bp, Homo sapiens
  misc_feature: HEFZJCU01CQ4XV.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatgggatcaactctcacactggaagcagagtctatgcggagagattccagggcagagtcaccctgaccacagagacatccacgaccacagtctacatggagctgtggagcctgagacctgaccgacaccggccctctacttactgtgcgaggcccctatccctacagttcgaccactcccaacggcctggttcgaccctctgggggcctaac

SEQ ID NO: 533635 - DNA, 529 bp, Homo sapiens
  misc_feature: HEFZJCU01B0E0X.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgacttactgggggcccaggggaagcgtttggtcaccgtctcctcagcctccc

SEQ ID NO: 533636 - DNA, 509 bp, Homo sapiens
  misc_feature: HEFZJCU01CKM2V.48.52.E08.1.454.heavy.3.raw
agtatacatacacgaccggtgctcgatttagtcgagctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaacgggtctagagtggatttcatacattaggagtggcagtagtcccatatactacgcagactctgtgaagggccgattcatcatctccagagacaatgccgagaactcactgttctgcaaatgaacagcctgagagacgaggacacgggctgtttattactgtgcgagaggtgcggatttcaccttacacgagggtctggttccgacccgttc

SEQ ID NO: 533637 - DNA, 492 bp, Homo sapiens
  misc_feature: HEFZJCU01ATMO9.52.19.B08.1.454.heavy.3.raw
cgcagtacgacacgaccggtgctcgatttagtgagtcagtaagggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaacgggccgatcatcatctccagagacaactccgagaacacgctgtatctgcaaatgatcaggctgagagctgaagacacggcttttaatattactggtgtcgtaaacttaatccgaac

SEQ ID NO: 533638 - DNA, 520 bp, Homo sapiens
  misc_feature: HEFZJCU01A8S4R.14.57.F02.1.454.heavy.3.raw
  modified_base (518)..(518): a, c, t, g, unknown or other
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgataccaatttgggaggggcctttnat

SEQ ID NO: 533639 - DNA, 480 bp, Homo sapiens
  misc_feature: HEFZJCU01BIKA3.22.36.D03.1.454.heavy.3.raw
acatacgcgtcacgaccggtgctcgatttagctgcgtcacgatctctcttgggtttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctccgagagcacagcggccctgggctgcctggtcaaggactacttccacgcgtatgt

SEQ ID NO: 533640 - DNA, 510 bp, Homo sapiens
  misc_feature: HEFZJCU01CKOVI.14.71.G05.1.454.heavy.3.raw
cgtctagtaccacgaccggtgctcgatttagtgtcgtcgcaagagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggcccgtatattactgttgcgaaacgccaagtatttttggagttggttattataccttttgacttc

SEQ ID NO: 533641 - DNA, 527 bp, Homo sapiens
  misc_feature: HEFZJCU01DIT8G.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctggggttttccttgttgttattttacaaggtgtccagtgtggaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctccaaggagatggattcagagaactctactttatcctgcaaatgaacagcctgacgaaccgacgacacgggcccgttctaatttacttgtgttcatacgtacctaggaatacaaccgaac

SEQ ID NO: 533642 - DNA, 497 bp, Homo sapiens
  misc_feature: HEFZJCU01B5Q90.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctctttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagtttatttcatatgatggaaatagtgacttctattcagactccgtgaagggccgattcaccgtctccagagacaattccaggccacacgctgttatctgcaaatgaacagcctgagagctgaggacacggctgtgtattactgtgcgaaagtatttctat

SEQ ID NO: 533643 - DNA, 516 bp, Homo sapiens
  misc_feature: HEFZJCU01DXFAP.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtatttactggtggtgggttataccgacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgtactactggggtaccg

SEQ ID NO: 533644 - DNA, 523 bp, Homo sapiens
  misc_feature: HEFZJCU01ETICA.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctcctgaagttgaactcagtgaccgctgcggacacggccgtgtattactgtgcgagccacaccgattacgattttggagtggccttgataactggggccagggggatcctggtcaccgtctcctcagcctccaccac

SEQ ID NO: 533645 - DNA, 512 bp, Homo sapiens
  misc_feature: HEFZJCU01BPN1E.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggccttttgactttctgggggccaggggacg

SEQ ID NO: 533646 - DNA, 403 bp, Homo sapiens
  misc_feature: HEFZJCU01BS7KU.16.72.G06.1.454.heavy.3.raw
tgtactactccacgaccggtgctcgatttagctacgactgcaagggaaaggggctggagtgggtctcatctattagtagtagtgatagtgccacatactacgcagactccgtgaagggccggttcaccatctccagagatagatccaagaacacgctgtatctgcaaatggacagcctgagagccgaggacacggccatatattactgtgcgaaagatctggggaatgactacgatggtaccaacgtccgcttggactcctggggccagggagccctggtcaccgtctcctcagcctccaccaagggcccatcggtcttccccctggcgccctgctccaggagcatctccgagagcacagcggccctgggctgcctggtcaaggactacttccgagtagtaca

SEQ ID NO: 533647 - DNA, 499 bp, Homo sapiens
  misc_feature: HEFZJCU01C04QO.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcgatccattagtagtaatagtgcctacagatactacgcagactcactgaagggccgactcaccatctccagagacaacgccaagaactcactgtatctgcaatgaacagcctgagagccgaggacacggctgtgtattactgtgcgagaggagctattatctcggaaccccg

SEQ ID NO: 533648 - DNA, 518 bp, Homo sapiens
  misc_feature: HEFZJCU01A39X1.17.78.H01.1.454.heavy.3.raw
cgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacgccaggccccccggacacagccttgagtggatgggatggatgaacgttgacaatgggaatacgagatattcacagaaattccagggcagagtcaccattaccagggacacatcccgcgaacacagcctacatggagctgacgggcctgacatcctgaagacacggctttatattactgtgcgcgagagtggctgggcaacgagtagggcacgaactggcgtaccgtacccccg

SEQ ID NO: 533649 - DNA, 386 bp, Homo sapiens
  misc_feature: HEFZJCU01B5TLP.18.60.F05.1.454.heavy.3.raw
tacgagtatgcacgaccggtgctcgatttagtacgtcatcagggaaagggctggaatatattgggattaccctcttacagtgggaccacccattacaacccgtccctcaaaagtcgactcaccatttccgtggacacgtcgaaaaacgagttctccctggacttgacctctgtgaccgccgcagacacggctgtttattactgtgcgagacgactacctgactccaatccatactttgactattggggccggggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 533650 - DNA, 561 bp, Homo sapiens
  misc_feature: HEFZJCU01BZXGY.18.78.H01.1.454.heavy.3.raw
tacgagtatgcacgaccggtgctcgatttagtgtgagtagtttgggtttggggctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtagaaaggcaggttcaccgtctccagaaatgattcaaagaacacggcgtatctgcaaatgaacagcctagaaaaccgaggacacggccgtgtattactgtactagacaggtggattactagtttggggggtagtttagtcgtacggaaaccggggggggttaaccgtacgtaccgtacg

SEQ ID NO: 533651 - DNA, 443 bp, Homo sapiens
  misc_feature: HEFZJCU01ATEXI.10.11.A11.1.454.heavy.3.raw
catagtagtgcacgaccggtgctcgatttagctacgactgcagggtgtacacctgtggttctcggggccgccggaaagggcccggagtggcttggtcggatctctctcactgggaacaccctatacaaccctctttcatgggtcgactctccctttcactggacctgtctgagaaccagttctccatgacactgacctctgtcatcgccgctgacacggccgtctatttctgcgcgtcctcatcccttattcatcatgatggttctacttattattacgagagatctgagtttgaccactggggccaggggcatgctagtcaccgtctccccagcctccaccaagggcccatcggtcttccccctggcaccctcctccaagagcacctctgggggcacagcggccctgggctgcctggtcaaggactacttcccactaccttg

SEQ ID NO: 533652 - DNA, 527 bp, Homo sapiens; identical to SEQ ID NO: 481767
  misc_feature: HEFZJCU01BYYU3.12.40.D07.1.454.heavy.3.raw

SEQ ID NO: 533653 - DNA, 373 bp, Homo sapiens
  misc_feature: HEFZJCU01BYELU.48.59.F04.1.454.heavy.3.raw
agtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctggggcacagcggccctggctgcctggtcaaggactacttcctatgtatact

SEQ ID NO: 533654 - DNA, 537 bp, Homo sapiens
  misc_feature: HEFZJCU01BXYMP.49.59.F04.1.454.heavy.3.raw
agtcgagagacacgaccggtgctcgatttagtacacacacttagggattggggcagctacaggtgtccagtcccaggtccagctggtgcaatctggggctgaggtgaagaagcctgggtcctcggtgaaggtctcctgtaaggcttctggaggcaccctcagcagttatactatgaattggggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccagggaaccctcggtcaccgtctcctcagcctccaccaacgggcccatcggtccttcccctcggcgacccctcctccaacgagcacctctcggggggcacgacgcggccctggggcctgcctcggtcaac

SEQ ID NO: 533655 - DNA, 367 bp, Homo sapiens
  misc_feature: HEFZJCU01BIFG8.9.33.C11.1.454.heavy.3.raw
  modified_base (313)..(313): a, c, t, g, unknown or other
tgatacgtctcacgaccggtgctcgatttagagtgagctcgtgggagaggagcccagcactagaagtcggcggtgtttccattcggtgatcagcactgaacgacagaggactcaccatggagtttgggctgagctgggttttcctcgttgctcttttaagaggtgtccagtgtcaaggtgcaactggtggagtcgtggggggggctggtccaggcctgggacggttcccgtgtagactctcctgtgcaggctctggattcaccttcgagtggctatggccagtgcgactggctccggcccagggctccggggnaagggggctaggagtgggtggcaattatatcgggtatgatgggaataagtaaag

SEQ ID NO: 533656 - DNA, 505 bp, Homo sapiens
  misc_feature: HEFZJCU01EOZZT.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggcccacctattattgttgcgcgacatgactacgctcaattctggggaccg

SEQ ID NO: 533657 - DNA, 489 bp, Homo sapiens
  misc_feature: HEFZJCU01B7IGQ.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtgcgtttattcgaagcgatgggactcatgaacatatgcagactccgtgaagggccgattcatcatctccagagacaactccaacaacacactggatctccaaatgaacagcctgagagtcgaggacaccggccgtatatttattgtgtcccttgatttacta

SEQ ID NO: 533658 - DNA, 508 bp, Homo sapiens
  misc_feature: HEFZJCU01DM8OY.52.33.C11.1.454.heavy.3.raw
cgcagtacgacacgaccggtgctcgatttagagtgagctcgttgggtttggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcatttggggcgcgccagggccccccggacaaaggtttgagtggatgggatggatcaccgctggcaatggtgacacaaaatattcacagaagttccagggcagagtcaccattaacagggacacatctgcgagtacaggctacatggaactgagcggcctgagatctgaggacacggctatttattactgtgacgagagggaagtgggatattgtggcagctccaggtgcccagccggccccttac

SEQ ID NO: 533659 - DNA, 532 bp, Homo sapiens
  misc_feature: HEFZJCU01CK05K.21.78.H01.1.454.heavy.3.raw
tcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggctatttacttgaccctgggggccggggaaccctggtcaccgtctccccaccctccaccaac

SEQ ID NO: 533660 - DNA, 542 bp, Homo sapiens
  misc_feature: HEFZJCU01A3HN7.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtcccgccggccaagggactggagtatattggacgaatctatgccagtgggaccgccatctacaaacccgtccctcaagagtcgagtcagcatgtcagtcgacacgtcccagaaccagttctccctgacagtgagttatatgaccgccgcagacacggccgtgtattactgtgtcgagagagggccgtttagttttaggaccagtctaggtttaaaaaccttcctaccttacggtctggacgttcgtgggggccacggggggaacctaac

SEQ ID NO: 533661 - DNA, 515 bp, Homo sapiens
  misc_feature: HEFZJCU01DGPGD.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtcgtggggcctagggactacggtcaccgtctcctcagcctccaccaagggcccatcggtcttcccctcggcc

SEQ ID NO: 533662 - DNA, 520 bp, Homo sapiens
  misc_feature: HEFZJCU01A9CMN.52.53.E09.1.454.heavy.3.raw
cgcagtacgacacgaccggtgctcgatttagagagagtgtgttgggtttggggacccaacaaccacatccctcctcagaagccccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcaccatcaccaggggacacatccgcgagcacagcctacatggagttgagcagcctgagaaatgaagacacggctgtatattactgtgcgagaggggaaatggcctccaccaagggcccagtcggtccttcccccgtggccacccctcctccaaac

SEQ ID NO: 533663 - DNA, 529 bp, Homo sapiens
  misc_feature: HEFZJCU01ESEAS.17.34.D01.1.454.heavy.3.raw
  modified_base (515)..(516): a, c, t, g, unknown or other
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagacttcaccataacccgcggacaaattaacgaacacagttaatctggagctgaacagcctgtcatctgaggacacgggcttctacttcttgtgcgaggagtaattactataacactgctccttttacacctcccttgacttctgggcnncgaacccggtccg

SEQ ID NO: 533664 - DNA, 536 bp, Homo sapiens
  misc_feature: HEFZJCU01A19JA.7.78.H01.1.454.heavy.3.raw
  modified_base (385)..(385): a, c, t, g, unknown or other
cgtgtctctacacgaccggtgctcgatttagtgtgagtagtttgggtttggggacccaacaaccacacccctcctaagaagaagcccctagaccacagctccacaccatggactggacctgggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactaccatgggatgggatcaacaccgacactgggaaccccactatgcccaggcccttcaacagggcggtttgtcttctccatgntacctctgtcgggacggcttatctgcagataaccgaaccttcaacctcgacgaccactgaccgttttatttttgtacgagtagcgtcgtctgtcagtgattgactactggggccagggaaccctggtcacccgtctcctctaggccctacc

SEQ ID NO: 533665 - DNA, 527 bp, Homo sapiens
  misc_feature: HEFZJCU01EZSBM.48.59.F04.1.454.heavy.3.raw
  modified_base (491)..(491): a, c, t, g, unknown or other
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctgggagtggattgggagtagtttaccacagtgggagcacctactacaacccgtccctcaaaagtcgaggcaccatatccgtagacacgtccaagaaccaattctccctgaagctgagctctgtgaccgccgcagacacggctgtctattacctgtgcgacggccccgagcgcaggtggtccgtttttgtagtgtccttttggaattntggttggggccgtaagggaacgaatggtcaccggtt

SEQ ID NO: 533666 - DNA, 539 bp, Homo sapiens
  misc_feature: HEFZJCU01CJS77.48.38.D05.1.454.heavy.3.raw
agtatacatacacgaccggtgctcgatttagtatctgatagttgggtttgggggggagaggagcccagcactgggattccgaggtgtttccattcggtgatcagcactgaacacagaggactcaccatggagttttggctgaggtgtccagtgtgaggtgtagctggtggagtctggaggaggcttgccccagcctgggaggtccctaagactttcctgtgcagcctctgggtttagtgtcactagtaggaagatgacttgggtccaccaggctccagggaaggggctggagcgggtcgcaattctttacagtggtgttaggacaacctacgcagactccgtgaaggggcgattcaccttctccagaggcaattccaagaacaccctgtgtcttcgtgggtctcatttctttatagcggtgttaggacaacctacgcagactccgtgaaggggcgattcaccttctccagagcaattccaagaacaccctgtatcttcaataaacagtctaagagccgaggacacggccctgtcgttac

SEQ ID NO: 533667 - DNA, 512 bp, Homo sapiens
  misc_feature: HEFZJCU01BRPI8.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagttgcgcagaagtttcagggcagggtcaccgatgaccagggacacgtccatcagcactgcctacatggagctgaccaggctgaaatttgaggtacgacggccgaatttaatttactgtggcaagggaacaaggcaataattagactccgtcccccggactttcg

SEQ ID NO: 533668 - DNA, 543 bp, Homo sapiens
  misc_feature: HEFZJCU01BXCM3.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccgaactacaacccgtccctcaagagtcgagttaccatttcattaaacacgtctaagaaccagttctccctgaagctgacctttgtgactgccgcggacacggccgtgtattactgtgcgagagacccctcgatagcagtggctgggtccacttagggttttgacttacgtcgggggccagggggaagctttgggtccaccggtctcccttcaagcccttcccg

SEQ ID NO: 533669 - DNA, 517 bp, Homo sapiens
  misc_feature: HEFZJCU01DQBG5.7.28.C06.1.454.heavy.3.raw
  modified_base (383)..(383): a, c, t, g, unknown or other
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccattcatcatctccaganacaacgccgacaactcactgtctctgctgatgagcagcctgagagccgacgacacggctatctattactgtgcgaaactctcatttccgttcattctgaatactggggccaggggaacccctgggtccgtcccg

SEQ ID NO: 533670 - DNA, 524 bp, Homo sapiens
  misc_feature: HEFZJCU01DMLFO.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtcttccccctcggcg

SEQ ID NO: 533671 - DNA, 505 bp, Homo sapiens; identical to SEQ ID NO: 477618
  misc_feature: HEFZJCU01D6DKF.12.33.C11.1.454.heavy.3.raw

SEQ ID NO: 533672 - DNA, 514 bp, Homo sapiens
  misc_feature: HEFZJCU01BKNWZ.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtccttcccctggcaccctcctccaagagcacctcgtgggggcacagcggccctgggctgcctggtcaaggactacttccgagtgcgtct

SEQ ID NO: 533673 - DNA, 505 bp, Homo sapiens
  misc_feature: HEFZJCU01B2RF4.48.67.G01.1.454.heavy.3.raw
agtatacatacacgaccggtgctcgatttagagtatacatattgggtttgggggctctcagagaggtgccttagccttggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggcattcatcatctccagagacaatgccgagaactcactgtttctgcaatgaacagcctgagagacggaggacacggcttgtttattactgtgcgagagtgcgggtatttcaccttaacacg

SEQ ID NO: 533674 - DNA, 518 bp, Homo sapiens
  misc_feature: HEFZJCU01BTF8O.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgagggccgattcatcatctccagagacaacgccgacaactcactgtctctgctgatgagcagcctgagagccgacgacacggctatctattacttgtgcgaaactctcacttccgttcatctagaattacgtggggccacgggaaccctggtcgtcccgg

SEQ ID NO: 533675 - DNA, 528 bp, Homo sapiens
  misc_feature: HEFZJCU01DZ3O0.49.12.B01.1.454.heavy.3.raw
  modified_base (420)..(420): a, c, t, g, unknown or other
  modified_base (501)..(501): a, c, t, g, unknown or other
agtcgagagacacgaccggtgctcgatttagtagtgtagattccgcgggtctgagagaggagcccagcccctgggattttcaggtgttttcatgtggtgatcaggactgaacagagagaactcaccatggagtctgggctgacgtggctttttcttgtggctattttaaaaggtgtccagtgtgacgtgcaactggtggagtctgggggaggcttggtacagccgggggggtccctgagactctcctgtacagcctctggcttcacctttagagtctatgacatgagttgggtccgccaggctccggggaaggggctggagtgggtctcaacgatcagtgaaagtggaagtaccacaaagtacgccgactccgtgaaggccggtgcaccatctccagagacaattcgaaggacactttanatctgcaactcaacagactgacaaccgcggacacggccgtctattactgtgtgaaagaagacggaccgctggacgaggacnccgagaggagaactcactactttgacc

SEQ ID NO: 533676 - DNA, 517 bp, Homo sapiens
  misc_feature: HEFZJCU01D9S46.7.28.C06.1.454.heavy.3.raw
cgtgtctctacacgaccggtgctcgatttagagctcacgtattgggtttgggggaggtctcagaggaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatggcaaaaggagacctactatttggactctgtgaggggccgattcatcatctccagagacaacgccgacaacctcactgtctctgctgatgagcagcctgagagccgacgacacggctatctattactgtgacgaaactctcattccgttcatctgaatacgtgggccagggaaccctggtcgtccg

SEQ ID NO: 533677 - DNA, 519 bp, Homo sapiens
  misc_feature: HEFZJCU01CAU4N.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagccccctttcttggtggcagccgcaacaggtgcccactcccaggttcagctggtgcagtctggggctgagatgaagaagcctggggcctcagtaaaggtctcctgcgaggcttctggttacaccttttctcaggtatactattgcctgggtgcgacaggcccctggaccaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggcccgtatattactgtgcgagagtacgtagcggctcgtctttgactacgtgggccgtgggaactcgtgtcaccgtctcctc

SEQ ID NO: 533678 - DNA, 525 bp, Homo sapiens
  misc_feature: HEFZJCU01BPIBM.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatcgaccacgaactccctccataaacacagcctacatggagttgaggagcctgacatctgacgacacggccgtctattactgtgcggagacgtcccgacgactccggtgagcctacggcaggcggtccctttggacctttcgtcgggggccgaggggacg

SEQ ID NO: 533679 - DNA, 521 bp, Homo sapiens
  misc_feature: HEFZJCU01BXA30.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgactcccggtgacgcctacggcgaggcggtcccttttgacctttcgtcgggggccaggggac

SEQ ID NO: 533680 - DNA, 514 bp, Homo sapiens
  misc_feature: HEFZJCU01EJGK2.12.55.E11.1.454.heavy.3.raw
  modified_base (480)..(480): a, c, t, g, unknown or other
  modified_base (483)..(483): a, c, t, g, unknown or other
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtactgagacttgagacacggctgtctattactgtgcgagagactacggtgaccttttctggtatttcgatctctgggccgtggcaccctggtcactatctcctcggcttccaccacgggcccatcggtcttccccgtggccgccngcnccagagcacctctcggggcacagcggtcccg

SEQ ID NO: 533681 - DNA, 492 bp, Homo sapiens
  misc_feature: HEFZJCU01EV90C.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactcctgtatctgcaaatgaacagtctgagagctgaggacacggccttgtattactgtgcaaggaggtatagcagctactggtacgactactggggccagggaaccctggtcaccgtctcctcagcctccaccaaggcccatcggtcttcccctggcgccctgctccaggagcgacctcccgagacgcacagccggcctgggctgcctggtcaaggactactcccacgacgagta

SEQ ID NO: 533682 - DNA, 515 bp, Homo sapiens
  misc_feature: HEFZJCU01B1EK5.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctcggcgccctgctccgaggagcacctccgagagcacagcggccctggg

SEQ ID NO: 533683 - DNA, 519 bp, Homo sapiens
  misc_feature: HEFZJCU01A1QDU.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggcttggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtcgcgaaactctcattccgttcactctgaatccgtggggccgaagggaacccctggtccgtcccg

SEQ ID NO: 533684 - DNA, 317 bp, Homo sapiens
  misc_feature: HEFZJCU01AFONT.47.84.H07.1.454.heavy.3.raw
agctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctgggggcacagcggccctgggctgcctggtcaagggactacttcctacgtgagct

SEQ ID NO: 533685 - DNA, 534 bp, Homo sapiens
  misc_feature: HEFZJCU01AWO4E.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactatgggccgacgggaacctggtcaccgtctcctcacgcctccaccaacggg

SEQ ID NO: 533686 - DNA, 530 bp, Homo sapiens
  misc_feature: HEFZJCU01BVLBC.11.25.C03.1.454.heavy.3.raw
  modified_base (358)..(358): a, c, t, g, unknown or other
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaagggctggagtgggtctcctttatttacagcagtggtagtacatattccgnagactccgtgagggccgattccaccatctccagagacaactctaagaacacgctgttcttcaatgaacagcctgagagccgatgacacggccgtgtattactgtgcgagagatggggcccacggaacgttacgtacgctagtggacgttcgtggggaccaagggaccgtacc

SEQ ID NO: 533687 - DNA, 495 bp, Homo sapiens
  misc_feature: HEFZJCU01B5HNG.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcggggggaggcgtggcccagcctgggaggtccctcagactctcctgtgcagcgtctggattcagtttcgctacacatggcatgcactgggtccgccagtcctccaggcaaggggctgcagtgggtggcgtttatcgaagcgatgggactcatgaacaatatgcagactccgtgaagggccgattcatcatctccagagacaactccaacaacacactggatctccaaatgaacacgcctgagagtcgaggacacgggccgtatatttattgtcgtcccttgtacttacta

SEQ ID NO: 533688 - DNA, 522 bp, Homo sapiens
  misc_feature: HEFZJCU01DFKP5.48.45.E01.1.454.heavy.3.raw
agtatacatacacgaccggtgctcgatttagtgagtcagtaagggaaagggggctctgggagaggagccccagccctgagattcccaggtgtttccattcagtgatcagcactgaacacagaggactcaccatggagttgggactgaactggattttccttttggctattttaaaaggtgtccagtgtgaactgcaactggtggagtctgggggaggcttgggtacagcctggcaggtccctggagactctcctgtgcagcctctggattcacctttggtgattatgccatgcactgggtccggcaagctccagggaagggcctggagtgggtctcaggtattagttggaatagtgatagcataggctatgcggactctgtgaagggccgattcaccatctccagagacaacgccaagaactccctgtatctgcaaatgaacagtctgagaactgaggacacggccttggtattactgttagtaaaagatatgtagtttttggggttcggggtaggtttgga

SEQ ID NO: 533689 - DNA, 391 bp, Homo sapiens; identical to SEQ ID NO: 519627
  misc_feature: HEFZJCU01AVP25.13.42.D09.1.454.heavy.3.raw

SEQ ID NO: 533690 - DNA, 480 bp, Homo sapiens
  misc_feature: HEFZJCU01BQFCP.22.36.D03.1.454.heavy.3.raw
acatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctccgagagcacagcggcctcgggctgcctggtcaaggactacttccagacgtatca

SEQ ID NO: 533691 - DNA, 517 bp, Homo sapiens
  misc_feature: HEFZJCU01EE5CE.10.53.E09.1.454.heavy.3.raw
  modified_base (452)..(452): a, c, t, g, unknown or other
  modified_base (515)..(515): a, c, t, g, unknown or other
catagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctggggagtccctcagactctcctgtttagcctctggattcaccttcagtagttatccttttgcactgggtccgtcaggctccaggcaaggggctggagtgggtggcagttatctcatttgatggagacaataaatactacagagactccgttcggggccgattcaccatctccaaagacaatttgaagaacacgctgtttctgcaatagaacagcctgagagctgngaacgacggctgtgtattacttgttcgtttgttctgactcgtcggggaacgtaccgttcagcnct

SEQ ID NO: 533692 - DNA, 566 bp, Homo sapiens
  misc_feature: HEFZJCU01D1MYH.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccaggggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggtcttccaccaacggggccccaagtccggttcctttccccccgttcgggccgtccccgtcgcctcccgacgggtacggaccctaccctccggtcggggggtccggaaccgacggaccggtcccc

SEQ ID NO: 533693 - DNA, 514 bp, Homo sapiens
  misc_feature: HEFZJCU01DRMIW.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggagctgggtccagcctggggggtccctgagactctcctgttcagcctctggattcacctttagtaggttttggatgagttgggtccgccaggctccagggaagggctggagtgggtgccaacatagagtacgatggaagtgagaaaaactatgtggactccgtgaagggccgattcaccatctccagagacaacgacaagaatttagtgtatctgcaaatgagcagcctgagagccgaggacacggctgtgtattattgtg

SEQ ID NO: 533694 - DNA, 432 bp, Homo sapiens
  misc_feature: HEFZJCU01CE7UP.4.37.D04.1.454.heavy.3.raw
agcactgtagcacgaccggtgctcgatttagtagcatactgttgggtttggggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcgagcacagcctacattgga

SEQ ID NO: 533695 - DNA, 534 bp, Homo sapiens
  misc_feature: HEFZJCU01BGREJ.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaatttttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccaggggcaccctggtcaccgtctcctcagcttccaccaagggcccatcggtcttccccctggccgccctgctccaggacgcacctactgggggcacgagccggcccgtggggcctgccgttgggtccgaaggaacctaccttcccattaccg

SEQ ID NO: 533696 - DNA, 526 bp, Homo sapiens
  misc_feature: HEFZJCU01D4L1H.10.85.H08.1.454.heavy.3.raw
catagtagtgcacgaccggtgctcgatttagtatcactcagtcgcggggggtctcagagaggagccttagcctggactccaaggcctctccacttggtgatcagcactgagcacagaggactcaccatggaattggggctgagctgggtttttccttgttgttatttttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcggaggacacggctgtatatttctgtgcggaggggagccggctagtggttcggacctcgtggggccaggggtaacccg

SEQ ID NO: 533697 - DNA, 524 bp, Homo sapiens
  misc_feature: HEFZJCU01BLBPC.48.53.E09.1.454.heavy.3.raw
agtatacatacacgaccggtgctcgatttagagagagtgtgttgggtttggggggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttcgacccctgggggccaggggataccgtggtcaccgtctcctcagcctttccaccaac

SEQ ID NO: 533698 - DNA, 523 bp, Homo sapiens
  misc_feature: HEFZJCU01CAAY5.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacaccgaacctactggccaatactatgggggcttgttctggggccaggggaccctggtcatcgtctccccagcctccaccagggcccatcggtcttccccctggccg

SEQ ID NO: 533699 - DNA, 517 bp, Homo sapiens
  misc_feature: HEFZJCU01AJXFX.10.79.H02.1.454.heavy.3.raw
  modified_base (195)..(195): a, c, t, g, unknown or other
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtnaagctggtggagtctgggggagcttggtcaagcctggaggtccctgagactctcctgtgcagcctctggattcgcctctgattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaatgaacacctgcgagcgaggacacggccgtaatatactgtgtcgagaataacccgtcgccgtggttatttaccg

SEQ ID NO: 533700 - DNA, 495 bp, Homo sapiens
  misc_feature: HEFZJCU01D5KTE.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgacaaatgaacagcctgagagctggaggacacggctgtgtattactgtgggagagatgggaggtcgatattgt

SEQ ID NO: 533701 - DNA, 532 bp, Homo sapiens
  misc_feature: HEFZJCU01DQD7X.7.78.H01.1.454.heavy.3.raw
  modified_base (155)..(155): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggngcccactcccaggtgcagctggtacagtctgggtctgaattgaggaagcctggggcgtcaggtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccacaacgg

SEQ ID NO: 533702 - DNA, 538 bp, Homo sapiens
  misc_feature: HEFZJCU01C89IN.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagctgagaaccgaggacacagccgtgtattactgtaccacatcccctagaaacgcgtcaactactactactacggtatggacctcgtggggaccg

SEQ ID NO: 533703 - DNA, 509 bp, Homo sapiens
  misc_feature: HEFZJCU01ANAQV.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctgggctgcctggtcgaaggactacttccgagtgcgtct

SEQ ID NO: 533704 - DNA, 522 bp, Homo sapiens
  misc_feature: HEFZJCU01BFXJY.10.85.H08.1.454.heavy.3.raw
  modified_base (497)..(497): a, c, t, g, unknown or other
catagtagtgcacgaccggtgctcgatttagtatcactcagtcgcgggggagaggagccttagccctggactccaaggcctctccacttggtgatcagcactgagcacagaggactcaccatggaattgggctgagctgggttttccttgttgttattttagaaggtgtccaatgtgaggagcagctggtggagtctgggggagcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctagtggttcggaccttcgnggggccagggaacccctggtcaccg

SEQ ID NO: 533705 - DNA, 527 bp, Homo sapiens
  misc_feature: HEFZJCU01ARLJK.12.40.D07.1.454.heavy.3.raw
atacgacgtacacgaccggtgctcgatttagtgatagagcgtaacaacagagggctcaccatggagtttgggctgagcgtggtttccgtcgttaggctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagacgagacacacgaacctactcggcaatactatgggggcttgttcgtgggccaggggaccctggtcatcgtctccccagcctccaccaagggcccatccggtcttccccctggccg

SEQ ID NO: 533706 - DNA, 517 bp, Homo sapiens
  misc_feature: HEFZJCU01BRMSI.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgaccacggccatatattactgtgacgaaagcaccgggcagttagtcgacccatactacttttgactaactggggaccg

SEQ ID NO: 533707 - DNA, 490 bp, Homo sapiens
  misc_feature: HEFZJCU01EHEQ6.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtggggtggcgattatatcacatgatggaactaatagacgctatgccgactccgtgaagggccgattcaccatctccagagacaattccaagaacacgcagtatctgacaaatgaacagcctgagagctgaggacacggctgtgtattactggtgggagagatggaggtcgat

SEQ ID NO: 533708 - DNA, 518 bp, Homo sapiens; identical to SEQ ID NO: 446027
  misc_feature: HEFZJCU01D1I4X.9.34.D01.1.454.heavy.3.raw

SEQ ID NO: 533709 - DNA, 561 bp, Homo sapiens
  misc_feature: HEFZJCU01EJM8X.48.40.D07.1.454.heavy.3.raw
agtatacatacacgaccggtgctcgatttagtgatagagcgtaacaacagagagctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaaggggctggagtgggtctcaaacgtgaacgttgatggcgggatcacaaaatacgcggactccgtgaaaggccgcttcaccgtctccagagacaacggcgagaatactctgtattttgcagatgagaaatctgagaggcgaggacaccgcgctttattattgtacaacgtcgttttacttttctaatggtggctcttacgaacgacatgactattggggtcggggaacctggtcaccgtctcctcagcctccaccaaggcccgactcggtcctttccccctcggtccacccttccctccaacggagtccacctccgtc

SEQ ID NO: 533710 - DNA, 533 bp, Homo sapiens
  misc_feature: HEFZJCU01C52P6.10.35.D02.1.454.heavy.3.raw
catagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttggttaagccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagtaacaccgtgtatctaggaaatgacgcagctggaaagcgatgaacacaggactctattattcgtacctactaagtacgaccctaacgaacgactgtcgggaagggactgcgtc

SEQ ID NO: 533711 - DNA, 513 bp, Homo sapiens
  misc_feature: HEFZJCU01AUEKI.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggaggttgaggagcctgacatctgacgacacggccgtctattactgtgcgagacgtcccacgactccggtgacgccgtacggcacggcggtcctttgactttcgtcgggggcc

SEQ ID NO: 533712 - DNA, 503 bp, Homo sapiens
  misc_feature: HEFZJCU01A97XN.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtagttccggggggacgacatgac

SEQ ID NO: 533713 - DNA, 524 bp, Homo sapiens
  misc_feature: HEFZJCU01DJFXW.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttatagtggtggtaccacatactacacagactccgtgaagggccgattcaccatctcagaagacaattccaggaacacattgtatcttcaaatgaataacctgagagccgaggacacggccagtgttattactgtgtgggggcatttacttgacccctgggggcccggggaacccgtggtccacgt

SEQ ID NO: 533714 - DNA, 498 bp, Homo sapiens
  misc_feature: HEFZJCU01BLI86.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattccaccatctccagagacaattccaagaacacgcagtatctgcaaatgaacagcctgagagctgaggacgacggctgtgtattactggtgggagagatgggaggtcggatattgta

SEQ ID NO: 533715 - DNA, 538 bp, Homo sapiens
  misc_feature: HEFZJCU01AURCQ.11.25.C03.1.454.heavy.3.raw
  modified_base (508)..(508): a, c, t, g, unknown or other
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattccaccatctcccagagacaactctaagaacacgctgtttcttcaatgaacagacctgagagccgatgacacggccgtgtattactgtgcgaggagagtcgggggcccacgaaccgttactaaccgntatggacgtcgtggggccaaggggaccacc

SEQ ID NO: 533716 - DNA, 497 bp, Homo sapiens
  misc_feature: HEFZJCU01EW4UK.40.37.D04.1.454.heavy.3.raw
tctagcgactcacgaccggtgctcgatttagtagcatactgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctaggtaggcctcaatactggggccggggaatcctggtcaccgtctcctcagcctccaccaagggcccatcggtcttccccctggcgccctgctccaggagcacctccgagagcacagcgccctgggctgcctggtcaaggactacttccagtcgctag

SEQ ID NO: 533717 - DNA, 507 bp, Homo sapiens
  misc_feature: HEFZJCU01CHO5S.48.79.H02.1.454.heavy.3.raw
agtatacatacacgaccggtgctcgatttagtgtcacacgaagggaaagggggctctgagagaggagccttagccctggattccaaggcctatccacttggtgatcagcactgagcaccgaggattcaccatggaactggggctccgctgggttatccttgttgctattttagaaggtgtccagtgtgaggtgcagctggtggagtcagggggaggcctggtcaagcctggggggtccctgagactctcctgtgcagcctctggattcaccttcagtacctataccatgaactgggtccgccaggctccagggaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacgttgggagaggagtgggaccttacg

SEQ ID NO: 533718 - DNA, 533 bp, Homo sapiens
  misc_feature: HEFZJCU01DDN2F.7.78.H01.1.454.heavy.3.raw
  modified_base (466)..(466): a, c, t, g, unknown or other
  modified_base (519)..(519): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggaatggatcaacaccgacactgggaaccccacctatgcccaggccttcacaggcggtttgtcttctccatggatacctctgtcgggacggcttatctgcagataaccaaccttcaacctgacgacactgccgtttatttttgtacgagagcgtcgtntgtcagtgaagttgtactactgggccgaggacccgtggtcaccgtctcctcancctccaccaacggg

SEQ ID NO: 533719 - DNA, 529 bp, Homo sapiens
  misc_feature: HEFZJCU01CLA7W.48.73.G07.1.454.heavy.3.raw
agtatacatacacgaccggtgctcgatttagctctacgctcagggcacgaccggtgctcgatttagctacgctctaagggaaagggggctttctgagagtcagggatctcatgtgcaagaaaatgaagcacctgtggttcttcctcctgctggtggcggctcccagatgggtcctgtcccagctgcagctgcaggagtcgggcccaggactggtgaagccttcggagaccctgtcccctcacctgcactgtctctggtggctccatcagcagtagtagttactactggggttggatccgccagcccccaggggaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgttttattaccttgtgtgagacgggtgccccaaagaaaagtgttttatccctggggccagggtaacccg

SEQ ID NO: 533720 - DNA, 531 bp, Homo sapiens
  misc_feature: HEFZJCU01D2ZVJ.52.16.B05.1.454.heavy.3.raw
cgcagtacgacacgaccggtgctcgatttagagctcacgtaagggtagagctcacgtaagggggctctgggagacgagcccagcactggaagtcgccggtgtttccattcggtgatcatcagtgaacacagaggactcaccatggagtttgggctgacctgggttttcctcgttgctcttttaagagatgtccagtgtcaggtgcacctggtggagtctgggggagcgtggtccagcctgggaagtccctgagactctcctgtagagactctggaatctacttcagtacttatggtctacattgggtccgccaggctccgggcaagggcctggagtgggtggcggtagtcacatatgaaagaaacaaaagtactacgcagactccgtgaagggccgattcaccatctccagagacaactccaagaacacggtctatctacaaatgaatagcctcgtaactgcggacacggctagtttactactgtgcgacgaggggccccgtcactatcaggaggactcctactactttcg

SEQ ID NO: 533721 - DNA, 515 bp, Homo sapiens
  misc_feature: HEFZJCU01EY085.10.87.H10.1.454.heavy.3.raw
catagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtctgggggaggcgtggtccagcctggggggtccctgagactctcctgtgcagcctctggattcgacttcgaaatgtctggcatgcactgggtccgccaggctccaacgaaggggctggagtgggtggcagttctttcatttgatagaaaaagggaatattatgcgacctccgtgaagggccgattcagcatctccagagacatttccaaggccacggtgtatctgcaaatgaccagcctgagaagtgaggacacggctatgtactattgtgcgaaggaccttccacctgaaactaatagtggggggctttgaac

SEQ ID NO: 533722 - DNA, 489 bp, Homo sapiens
  misc_feature: HEFZJCU01C0AIG.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccgatggaccagggacacgtccatcagcacgtccatcagcacagcctacatggacctgagcggcctgacctatccgtgaacgacgacggtccgtatatttctgtgcggaggg

SEQ ID NO: 533723 - DNA, 522 bp, Homo sapiens
  misc_feature: HEFZJCU01CZ0UB.26.57.F02.1.454.heavy.3.raw
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggttcaccatctccagagatgattcagagaacacggcgtatctgcaaatagaacagcctagaaaaccgaggaacacggccgtgtattactgtgccagacatccgtcgtattacgtactttttctagttcggt

SEQ ID NO: 533724 - DNA, 324 bp, Homo sapiens; identical to SEQ ID NO: 444475
  misc_feature: HEFZJCU01AO73F.18.17.B06.1.454.heavy.3.raw

SEQ ID NO: 533725 - DNA, 429 bp, Homo sapiens
  misc_feature: HEFZJCU01C9T8O.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggacctcaccatggagtttgggctgagctggattttccttgctgctattttaaaaggtgtccagtgtgaggtgcgagctggtggagtctgggggaggcttggtaaaggccgggggggtcccttaggactcccctgtacagcctctggattcacttcagtaaggcctggatgaactgggtccgcaggctccagggaagggctggagtgggtggtccgtattaaaccaaaacttgatggtgggaacacgagactacgctgcaccgtagaagcagacttcaccatctcgaagagatgattacaaaagc

SEQ ID NO: 533726 - DNA, 541 bp, Homo sapiens
  misc_feature: HEFZJCU01ESV5Q.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggcgtgtattactgtgcgagatgtaggaaaagtatggctgttgtttagttggggccaggggacgtcccgtggtcctaccg

SEQ ID NO: 533727 - DNA, 521 bp, Homo sapiens
  misc_feature: HEFZJCU01ATGG1.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgacaaaggagacctactatttggactctgtgagggccgattcatcatctccagagacaacgccgacaactcactgtctctgctgatgagcagcctgagagccgacgaccgacggctatctattactgtgcgaaactctcattccgttcactctagtaactacgtggggccaacgggaaccctggtccgtccc

SEQ ID NO: 533728 - DNA, 502 bp, Homo sapiens
  misc_feature: HEFZJCU01EZT8E.52.60.F05.1.454.heavy.3.raw
cgcagtacgacacgaccggtgctcgatttagtacgtcatcagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactgggtccgccaggctccaggcaaggggctggagtgggtggcagttatatcatatgatggaagtaagatatactatgcagactccgtagaagggccgattcaccatttccagagacaactccaagaacacgctgtatttgcaaatgaacagcctgagagctggaggacgacggctgtgttattactgtgctaacttaatactacggaggtaaccg

SEQ ID NO: 533729 - DNA, 544 bp, Homo sapiens
  misc_feature: HEFZJCU01B6OSU.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttcagtagtttattggatgacttgggtccgccagactccagggaaggggctggagtgggtggccaacataaagcaagatggaactgccgagtttacgtggactctgtgaagggccgtttcaccatctccagagacaacgccaagattcactgtatctacaactgaacagcctgagagtcgcagacacggccgtgtattactgtgcgagatgaggaaaagtaagtggctgttgtttagttggggtccgaggggacgccgtggtccgtaccg

SEQ ID NO: 533730 - DNA, 529 bp, Homo sapiens
  misc_feature: HEFZJCU01E1GXA.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggacgcgacctcccgaagacggacacacgacggcccctcggggcgtcg

SEQ ID NO: 533731 - DNA, 518 bp, Homo sapiens
  misc_feature: HEFZJCU01BCR01.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctgggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctaattactgtgcgaaactctcacttcgttccatctgaatacgtggggccacggggaaccctggtccgtccg

SEQ ID NO: 533732 - DNA, 507 bp, Homo sapiens; identical to SEQ ID NO: 446095
  misc_feature: HEFZJCU01DF0O8.10.38.D05.1.454.heavy.3.raw

SEQ ID NO: 533733 - DNA, 518 bp, Homo sapiens
  misc_feature: HEFZJCU01EU8MD.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtaccttacaatgaccaatatggaccctgtggacacagccacatattactgttcacgctctatggtttcggggagttattagtccctactttgactactggggccagggactactggtcaccgtctccgtcagcctccaccaacggggccc

SEQ ID NO: 533734 - DNA, 511 bp, Homo sapiens
  misc_feature: HEFZJCU01A3PTH.48.31.C09.1.454.heavy.3.raw
agtatacatacacgaccggtgctcgatttagacgtctcatcaaggaaggaagggggagagaggagccttagccctggattccaaggcctatccacttggtgatcagcactgagcaccgaggattcaccatggaaccctggggctccgctgggttttccttgttgctattttagaaggtgtccagtgtgaagtacagctggtggagtctgggggaggcctggtcaagcctggggggtccctgagactctcctgtgcaacctctggattcacattcactagatataccatgaactgggtccgccaggctccagcgagggggctggagtgggtctcctccataagtagtggcagttcttacttacattacgcagactcagtgaagggccgattcgccatctccagagacaacgccaacaactcactgtttctgcagatggacaacctgagaggcgaggacacggctgtatattactgtgtctccccataccatcgcagctcggtggcacggtac

SEQ ID NO: 533735 - DNA, 534 bp, Homo sapiens
  misc_feature: HEFZJCU01C1WLI.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttattacaattctggtaccacatactactccgaccccgtgaagggccgattaaccatctccagagacgattccgagaacacggtgtatcttcaatgaacaacctgagagccgacgacacggccgtttattactgtgcgagagattcgagtggttcgggggacctcgaccctggtttcctacttcgtaatctacgtcgggggtccgtc

SEQ ID NO: 533736 - DNA, 532 bp, Homo sapiens
  misc_feature: HEFZJCU01CGDB3.17.34.D01.1.454.heavy.3.raw
  modified_base (506)..(506): a, c, t, g, unknown or other
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtcccagttggtgcaatctggggctgaggtgaagacgcctggggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttcngggtccatcggaacccgtcaccgtcc

SEQ ID NO: 533737 - DNA, 536 bp, Homo sapiens
  misc_feature: HEFZJCU01AKESR.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcggtccctatcgttgacacaccaaactacgcacagaagttccagggcagactcaccataaccgcggacaaattacgaacacagtaatctgagctgaacagcctgtcatctgaggacacgggcttctacttctgtgcgaggagtaattactattaacactgctcctttttacacctcccttgactttctggggtccaatggaaccccggttcgacccgtt

SEQ ID NO: 533738 - DNA, 526 bp, Homo sapiens
  misc_feature: HEFZJCU01A203J.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtaagcagttggtggagactggaggaggcttgatccagcctggggggtccctgagactctcctgtgcagtctctgggttcgtcagtggcgactacatgagctgggtccgccaggctccagggaagggcctggagtggatctcacttatttataggtggtggtaccacatactacacagactccgtgaagggccgattcaccatctcagaagacaattccaggaacacattgtatctcaaatgaataactgagagccgaggacacggcatgtattactgtgtggggcatttactgaccctgggggccgggaaccctggtcaccgtctccccaccctcaccg

SEQ ID NO: 533739 - DNA, 502 bp, Homo sapiens
  misc_feature: HEFZJCU01EXWQR.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctacggaaccccgat

SEQ ID NO: 533740 - DNA, 540 bp, Homo sapiens
  misc_feature: HEFZJCU01DY89J.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaataatggcttgtgttttattgggggccaggggagccctggtctaccg

SEQ ID NO: 533741 - DNA, 486 bp, Homo sapiens
  misc_feature: HEFZJCU01DGE8S.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagcacggccatttattactgtgcgagagatgcagggcccttcccacatcggttatttctttgactcctggggccagggaccctggtcaccgtct

SEQ ID NO: 533742 - DNA, 506 bp, Homo sapiens
  misc_feature: HEFZJCU01D7K0M.48.73.G07.1.454.heavy.3.raw
  modified_base (389)..(389): a, c, t, g, unknown or other
agtatacatacacgaccggtgctcgatttagctctacgctcaggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaanctgagctctgtgaccgccgcagacacggctgtctattactgtgcgaggccccgagcgcagtggctttttgtatgcctttgatatggttggggccgaagggactaagtggtcgtaccg

SEQ ID NO: 533743 - DNA, 500 bp, Homo sapiens
  misc_feature: HEFZJCU01CSJN7.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccaggccgggggggtccctgagactctcctgtctagtctctggattcgccttcagtgactatgccatgaagtgggtccgccaggctccaggtaagggctggaatggatttcatacattagcagtagtggtgcgaccatatactacgcagactctgtgaagggccgattcatcatctccagagacaatggcaacaactcactgtatctggaatcaacagcctgagagtcgaggacacggactgtatattatgtgcgagacgccccctacggtgtaccg

SEQ ID NO: 533744 - DNA, 512 bp, Homo sapiens
  misc_feature: HEFZJCU01CWVM8.51.36.D03.1.454.heavy.3.raw
cgatcgtatacacgaccggtgctcgatttagctgcgtcacgatctctcttggggggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactgggggctggatccggcagccccccgggaaggggcctggattggattggcagtatcagttatactgggaccaccttcttcaagtcgtcgctcaagagtcgagtcaccatgaccgcggacacgtccaaggaccagttctccctgaagctgacctctgtgaccgccgcagacacggcttgtatttctgtgctagatataatggtggtgacagtggtgcctactacggagtcttttgattagtttggggccaaggcacgtaaggtcaccgtctcatcacg

SEQ ID NO: 533745 - DNA, 548 bp, Homo sapiens
  misc_feature: HEFZJCU01DAXK9.53.68.G02.1.454.heavy.3.raw
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggcccttagtttcggtttttggacttggttctcccatggatccctactttgagtactggggccgcggagccctggtcaccgtcctcctcacgcctccacccaagggcccagtccggtccttcccccctggtccacccct

SEQ ID NO: 533746 - DNA, 444 bp, Homo sapiens
  misc_feature: HEFZJCU01CU0NI.18.59.F04.1.454.heavy.3.raw
tacgagtatgcacgaccggtgctcgatttagtacacacacttagggattggggtctgggaggaggagccccagccttgggattcccaagtgttttcattcagtgatcaggactgaacacagaggactcaccatggagtttgggctgagctggattttccttgctgctattttaaaaggtgtccagtgtgaggtgcagctggtgggagtctggggggaggcttggtaaagcccgggggggtcccttagactccctgtacagcctctggattcacgtttcagtaaggcctggatgaactgggtccgccaggctccgagggaaggggctggagtgggttggccgtattaaaacaaactgatggtgggacaacagactacgctgccacccgtggaaacggcagattccaccaatctcgaagaagatgtattacaaaagacacgctgta

SEQ ID NO: 533747 - DNA, 527 bp, Homo sapiens
  misc_feature: HEFZJCU01B3TVE.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggggccggggaacccgtggtcaccgtctccccaccctccaccg

SEQ ID NO: 533748 - DNA, 511 bp, Homo sapiens
  misc_feature: HEFZJCU01DLRUS.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaggcagattcatcatctcaagagatgattccaacggcatcgcctatctgcagatgacagcctgaagaccgaggacacagccgtctattactgtagttagggtagttttacgtatttttggta

SEQ ID NO: 533749 - DNA, 528 bp, Homo sapiens
  misc_feature: HEFZJCU01BSQCU.7.78.H01.1.454.heavy.3.raw
  modified_base (388)..(388): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctntgtcgggacggcttatctgcagataaccaaccttcaacctgacgacactgccgtttatttttgtacgtagagcgtcgtctgtcagtggaattgactactgggccgagggaccctggtcaccgtctcctcagcctccacca

SEQ ID NO: 533750 - DNA, 518 bp, Homo sapiens
  misc_feature: HEFZJCU01CVXCI.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtacagcctctgggttcaccgtcagtcacacctacatgagctgggtccgccaggctccagggaaggggctggagtgcgtctcttttatttatagtagtggtagtacatactccgcagactccgtgaggggccgattcaccatcctccagagacaattccaagaacacgctgtttcttcaaatgaacagcctgagagccgatgacacggccgtgtattactgtgcgagagatggggcccacgaacttactacgtctatggacgtctggggccgaac

SEQ ID NO: 533751 - DNA, 524 bp, Homo sapiens
  misc_feature: HEFZJCU01CWZIZ.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacgacggccatattatttctgtagcgcgaggtaattttccggactttcctgggtaataatttaacttggggtttagggaaacctaccttta

SEQ ID NO: 533752 - DNA, 505 bp, Homo sapiens
  misc_feature: HEFZJCU01BW61I.53.62.F07.1.454.heavy.3.raw
cgcgtatacacacgaccggtgctcgatttagtagtcgcataaagggaaaggggtagtcgcataaagggaaagggggaggtgtgtcacaagatttgggctctgggagacgagcccagcactggaagtcgccggtgtttccattcggtgatcatcacttgaacacagaggactcaccatggagtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctatgcactgggtccgccaggctccaggcaaggggctgggagtgggtggcacttatctcatctgatggaagagatgtctattacgcagactccgtgaagggccgattcaccatctccagagacaattccaagaacacactgtatctgcaaatggacagtctgagaactgaagacac

SEQ ID NO: 533753 - DNA, 484 bp, Homo sapiens
  misc_feature: HEFZJCU01CZY5W.19.13.B02.1.454.heavy.3.raw
  modified_base (457)..(457): a, c, t, g, unknown or other
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgagggccgattcaccatctccagagacaattccaagaacacgctgtatctgcaaatgaacagcctgagagctgaggaacncggctgtgtaattctgtgcgaggcggt

SEQ ID NO: 533754 - DNA, 497 bp, Homo sapiens
  misc_feature: HEFZJCU01EVWJX.22.86.H09.1.454.heavy.3.raw
acatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgtaagggccgattcaccatctccagagacaactccaagaacactctgtttctaccaaatgaacgagccgtgaggaggcgaggaccgacggcagtgtattactgtgcgagagagtcgacatgtaacg

SEQ ID NO: 533755 - DNA, 546 bp, Homo sapiens
  misc_feature: HEFZJCU01A1OR6.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcaccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacgggactacggtgactacgttcgggggttcgtaccccgtggggccgacgggaacccgtgggtaccaccgttcctccttccgagccctccgaacccg

SEQ ID NO: 533756 - DNA, 522 bp, Homo sapiens
  misc_feature: HEFZJCU01C0S9L.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacacttgattactggggccggggaaccctggtcgccgtctcctcagcctccaccaaggcccatcggtcttcccctggcaccctcctccaagagcacctctgggggcacgagcggccctgggcgtgcctggtcaggactacttccagacgtatcactgac

SEQ ID NO: 533757 - DNA, 532 bp, Homo sapiens
  misc_feature: HEFZJCU01EP8BN.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttactacctcccttcgacttctcggggcagtcggaacccgtaccg

SEQ ID NO: 533758 - DNA, 370 bp, Homo sapiens
  misc_feature: HEFZJCU01A51H0.3.42.D09.1.454.heavy.3.raw
agacgcactccacgaccggtgctcgatttagacacatacgcagggaaggggctggagtggattgggagtttctattatggtgggggaacctactacaacccgtcccttaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcggtcttccccctggcaccctcctccaagagcacctctgggggcacagcggccctgggctgcctggtcaggactacttccgagtgcgtct

SEQ ID NO: 533759 - DNA, 493 bp, Homo sapiens
  misc_feature: HEFZJCU01CNVX7.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggagcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgagggccgattcaccatctccagagacaattcccagaacacggtctatctgcacctgaccagcctgagaactgacgtacacgtctctctactactgtgtcgagagagttgacgagtct

SEQ ID NO: 533760 - DNA, 573 bp, Homo sapiens
  misc_feature: HEFZJCU01EFB0H.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttactccctgaactgaccgcctgtgaccgccgcggacacggctgtgtattactgtgcgagacgaatgggcggggtggcgtacgacgtttgacgtttttggggcccgtaggggaaacccttgggtcgacccgttccgttcccccaggtccgtttccctaccctaaacggggaccccgacgttccgggttccgttttccccccc

SEQ ID NO: 533761 - DNA, 508 bp, Homo sapiens
  misc_feature: HEFZJCU01BH74C.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacacgatgatttttggatgtctggggccaaggtacagcgtcaccgtcgcctcagcctccaccaaggcccatcgtcttcccctggcaccctcctccaagagcacctcgt

SEQ ID NO: 533762 - DNA, 492 bp, Homo sapiens
  misc_feature: HEFZJCU01A30OF.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactggggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtctcccctgcgcctgctcagagcactc

SEQ ID NO: 533763 - DNA, 519 bp, Homo sapiens
  misc_feature: HEFZJCU01DNXOL.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctgggattcacgttttacctcctatagttatcaactgggtgcgccaggccgctggacaacgacctgagtggatgggatgggcgaaccctaacactggtgtcacagtgtcttcacccatcctccgggacagacttaccatgaccacgaactcctccataacacagcctacatggagttgaggagcctgacatctgacgacacggccgtctattactgtgcgagagtcccacgatccggtgacgtcctacggcaggcggtcctttgacttcgtcgggggtccgaggggac

SEQ ID NO: 533764 - DNA, 485 bp, Homo sapiens
  misc_feature: HEFZJCU01E0ZWV.51.80.H03.1.454.heavy.3.raw
cgatcgtatacacgaccggtgctcgatttagctgtgcgtcgaagggaaagggggcagagcctgctgaattctggctgaccagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctggggaaggacatactacaggtccaagtggttttaatgattatgcagtatctgtgaaaagtcgaataaccatcaacccagacacataccaagaaccagttcctccctgacaactgaactctgtgactcccgaggacaccggccgtgtattactgtgcaagaggttaggtaac

SEQ ID NO: 533765 - DNA, 507 bp, Homo sapiens
  misc_feature: HEFZJCU01E06G6.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaaggcccatcggtcttcccctggccgcctcgctccaggacg

SEQ ID NO: 533766 - DNA, 507 bp, Homo sapiens
  misc_feature: HEFZJCU01D6MQ4.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccactatattttctgtgcgcggagaatttcgacttcgtgaataattacttgggttggaaactacgtta

SEQ ID NO: 533767 - DNA, 528 bp, Homo sapiens
  misc_feature: HEFZJCU01D6WB8.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgtcgagagagacacacgaacctactggccaatactatgggggcttgttctggggccaggggaccctggtcatcgtctccccagcctccaccaagggcccatcggtcttccccctggcgcctcg

SEQ ID NO: 533768 - DNA, 537 bp, Homo sapiens
  misc_feature: HEFZJCU01D3GED.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccactgtgaggagcagttggtggagactggaggaagcctgatccagccgggggggtccctgagactgtcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggcccggggaacccgtggtccaccgtctccccacccctcccaccaacc

SEQ ID NO: 533769 - DNA, 535 bp, Homo sapiens
  misc_feature: HEFZJCU01B56BB.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatccttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgtagagcgtcgtctgtcagtggaattgactactggggccacgggaacctggtcaccgtctcctcagtcctccaccaacggg

SEQ ID NO: 533770 - DNA, 482 bp, Homo sapiens
  misc_feature: HEFZJCU01BBXFM.22.36.D03.1.454.heavy.3.raw
  modified_base (439)..(439): a, c, t, g, unknown or other
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccaggggcaccctggtcaccgtctcttcagcctccaccaagggcccatcggtcttcccctggcgccctgctccaggagcacctccgagaggcaacngcggcctgggctgcctggtcaaggactacttccagacgtatca

SEQ ID NO: 533771 - DNA, 503 bp, Homo sapiens
  misc_feature: HEFZJCU01D03QI.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgaccaagaactcactgtatctgcaaatgaacacgcctgagagccgaggacacggctgtgtatactgtgcgagaggagctattatctggaaccccgtagt

SEQ ID NO: 533772 - DNA, 499 bp, Homo sapiens
  misc_feature: HEFZJCU01D1AG9.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagtttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtggggtcgcaggtatttttataggtgggacgacattctacggagactccatggagggccgattcaccatctccagagacttttctcagaacacactgtctctttcaaatgaacagcctgagggccgaggacacggccgtctattattgtgtgagagtttatggcgatggctggtgga

SEQ ID NO: 533773 - DNA, 531 bp, Homo sapiens
  misc_feature: HEFZJCU01A72QV.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctaacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggtccaggggaccctggtcatcgtctccccagcctccaccaacgggcccatcggtcttccccctggccgccctcg

SEQ ID NO: 533774 - DNA, 524 bp, Homo sapiens
  misc_feature: HEFZJCU01APRYY.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgacccgtgaagggccgattaaccatctccagagacgattccgagaacacggtgtatcttcaaatgaacaacctgagagccgacgacacggccgtttattactgtgcgagagattcgagtgggttcggggacctcaccctggttctacttcgatctctggggccgt

SEQ ID NO: 533775 - DNA, 520 bp, Homo sapiens
  misc_feature: HEFZJCU01A949L.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctgggagtgggtaggtttcattagagccatggcttatgctgggacaacagaatacgccgcgtctgtgaaaggcagattcatcatctcaagagatgattccaacggctatcgcctatctgcagatgaacagcctgaagaccgaggacacagccgtctattactgttagttagggtagttttacgtattttggtagtggatattaa

SEQ ID NO: 533776 - DNA, 507 bp, Homo sapiens
  misc_feature: HEFZJCU01EV3LJ.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactggaggagcctgagatctgacgacacggccgtatatttcttgcgcgagagagtaaagtgacgtggtagttccggggggacacatgacaccg

SEQ ID NO: 533777 - DNA, 509 bp, Homo sapiens
  misc_feature: HEFZJCU01EZHOP.3.67.G01.1.454.heavy.3.raw
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaatagaacagcctggaagaccgcggacacgagccatgtatttattgtactagttaggaactactatacg

SEQ ID NO: 533778 - DNA, 529 bp, Homo sapiens
  misc_feature: HEFZJCU01A1CTU.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattggggtgcgacagacccctggacaagggcttcagtggatgggatggatcaacaccaacaccggcaacccaacctacgcccagggtttcaccggacgctttgtcttctccttggatacctctgtcagggcgcgtatctgcagatcaccagccttcaggctgaggacactgccatttattactgtgcgagagagggggagacgtggagtagaacgtaaatacgggaaaccgtttgacttttgggccagggaaccctggtcaccgtctcctcagcctccaccaagggcccatccggtcttcccctggcaccctcctccaagagcacctctggggcacagcgcctggctgcctc

SEQ ID NO: 533779 - DNA, 507 bp, Homo sapiens; identical to SEQ ID NO: 498533
  misc_feature: HEFZJCU01DW4W9.16.34.D01.1.454.heavy.3.raw

SEQ ID NO: 533780 - DNA, 547 bp, Homo sapiens
  misc_feature: HEFZJCU01DML8J.16.86.H09.1.454.heavy.3.raw
tgtactactccacgaccggtgctcgatttagtgctatagactgggtttgggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgttgcgagagacccctccgatagcaggtcggctggtccactagggttttgacttactgggggcccagggggaacgcgtttggtccaccggtcctcccttcacgtcctaccccg

SEQ ID NO: 533781 - DNA, 513 bp, Homo sapiens
  misc_feature: HEFZJCU01AUJBD.11.40.D07.1.454.heavy.3.raw
  modified_base (504)..(504): a, c, t, g, unknown or other
cgagagataccacgaccggtgctcgatttagtgatagagcgtaacaacagaggactcaccatggagtttgggctgaccttttttgggttttcctcgttgctcttttaagaggtgtccagtgtcaggtgcagctggtggagtctgggggaggcgtggtccagcctgggaggtccctgagactctcctgtgcagcctctggattcatcttcaatacctttggcatgcactgggtccgccaggcctccaggcaagggactggagtggctatcatttatgtcatttgatggaactaatatatactattctggggccgttaagggtcgattcaccatctccagagacaattccaggaacacgctgtatctgcaattacacagcccgacaactgacgacacggctgtttattactgtgccacagatatacgcgaatttagcagggggtggccagtacagtcatacatttgccaaactggggccagggaaccctggtcatcgtctcctcancctccaccg

SEQ ID NO: 533782 - DNA, 501 bp, Homo sapiens
  misc_feature: HEFZJCU01D7K35.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctcgtatctgcaaatgaacagcctgagagctgaggacacggctgtgtattactgtgcgaaagtatttctatagaggtgacgtac

SEQ ID NO: 533783 - DNA, 532 bp, Homo sapiens
  misc_feature: HEFZJCU01DJGLI.49.38.D05.1.454.heavy.3.raw
  modified_base (457)..(457): a, c, t, g, unknown or other
agtcgagagacacgaccggtgctcgatttagtatctgatagttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggcctttgagtggatgggatggatcaactctgacaatggtaacagacaacattcaccgaagttccaggacaagagtcaccattacccgagacacttccgcgaacacagcctacatggaactgagcggcctgagatttgaagacacggctgtgtattactgtgcgagngacaacggtcgtcatgggatttgactacgtggggccgagggaaccccggtcaccgtctcctctcgcctccaaccg

SEQ ID NO: 533784 - DNA, 511 bp, Homo sapiens
  misc_feature: HEFZJCU01BL0SE.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaatagaacagcctgagaattgaggactcgggtatatactactgtgcccgtgaccccctcgactgataaaccggacgtggttcgaccccgtggggccgacgggaacccgtggtccaccgtccgtcctcc

SEQ ID NO: 533785 - DNA, 493 bp, Homo sapiens
  misc_feature: HEFZJCU01DOW40.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggaggtccctgagactctcctgtacagcctctggcttcaccttcattacctatggcatgcactgggtccgccagactccaggcagggggctggagtgggtggcagttattcatatgatggaaatagtgacttctattcagactccgtgaagggccgattcaccgtctccagagacaattccaggcacacgctgtatctgcaaatgaacagacctgagagctgaggacacgggctggtgtattactgtgcgaaagatttctat

SEQ ID NO: 533786 - DNA, 534 bp, Homo sapiens
  misc_feature: HEFZJCU01BYW0J.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctccctttcgacctttcgtggggccagtggaaccccggtccg

SEQ ID NO: 533787 - DNA, 500 bp, Homo sapiens
  misc_feature: HEFZJCU01DM7P1.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccaacgaccacagtctacatggagctgtggagcctgagcctagacgacacggccctctattactgtgcgacggccctatcctacagtgaccactccacgctggttcgaccttc

SEQ ID NO: 533788 - DNA, 517 bp, Homo sapiens
  misc_feature: HEFZJCU01DNBF6.52.83.H06.1.454.heavy.3.raw
  modified_base (456)..(456): a, c, t, g, unknown or other
cgcagtacgacacgaccggtgctcgatttagatcacgtgcgtcgcgggggggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaagtaacaaatactatgtagactccgtgaagggccgattcaccatctccagagacaattccaagaatacgctgtatctgcacatgaacagcctgagagccgaagacacgggtntttagttactgtacgaacttaattacggaggacaaccggtaaccccgtccgcgacggcgac

SEQ ID NO: 533789 - DNA, 539 bp, Homo sapiens
  misc_feature: HEFZJCU01A3I4D.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaacgggcccgatccggtcctttcccccttcgggccgtccctcgctcctaggacgcgacctcccgacgaagccacacgccggccccgtcgggctc

SEQ ID NO: 533790 - DNA, 530 bp, Homo sapiens
  misc_feature: HEFZJCU01AQRJB.3.70.G04.1.454.heavy.3.raw
agacgcactccacgaccggtgctcgatttagtgtagtgtgaagggaaagggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccagcccggggggtccctgagactctcctgtgaagtctctgggttcactgtcagtagcaactacatgaactgggtccgccaggctccagggaaggggccggagtgggtctcaattatttatggcgatggtagtacgtactacgcagactccgtgcagggccgattcaccatctccagagacaatttcaagaatacgttgctccttcaatgaacaacctgagaaccgaggacacggccgtatattattgtgcgagtagtacggtggtgaatgtgggtgttaactggggctgggaccctggtcacgtctcctcag

SEQ ID NO: 533791 - DNA, 512 bp, Homo sapiens
  misc_feature: HEFZJCU01B3RC3.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctgaaatgaacatctgagagtcgacgatacggctgtctatcattgtgttttcgatgccttcggtccgcgggacgttctggggccgagggaacccgtc

SEQ ID NO: 533792 - DNA, 533 bp, Homo sapiens
  misc_feature: HEFZJCU01DGGM3.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggcccggggaacccgtggtcaccgtctccccacccctccacccg

SEQ ID NO: 533793 - DNA, 503 bp, Homo sapiens
  misc_feature: HEFZJCU01D9DDL.48.43.D10.1.454.heavy.3.raw
agtatacatacacgaccggtgctcgatttagactagcagtaagggggagagaggagccttagccctggattccaaggcctatccacttggtgaccagcactgagcaccgagggttcaccatggaattggggctccgctgggttttcctggttgctgttttagcaggtggcagtgtgacgtgcacctgctggagtcggggggaggcctggtcaagcgggggggtccctgagactctcttgtgaagcctctaaaatcagtctcgagagttccagcatgaactgggtccgccaggctccagggaagggcctggagtgggtctcatccatcagcagtggaggcaaccatatgttgtatgccgactcagtgaggggccgattcagcgtctccagagacaacgccaagatgtcagtatatctggaaatgaacaacctaagagtcgaggacacggctgtctactactgtgcgagagatgtgattccgagtgactggtgggtgtactttga

SEQ ID NO: 533794 - DNA, 503 bp, Homo sapiens
  misc_feature: HEFZJCU01AVZVA.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctgggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacaccggcctatttattacttgtgtacaaggaacagacatatagactccgtccccggactttcg

SEQ ID NO: 533795 - DNA, 519 bp, Homo sapiens
  misc_feature: HEFZJCU01DW33M.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggacttggttctggggccaggggaccctggtcatcgctccccgagcctccaggagcacctccgagacgcacagcc

SEQ ID NO: 533796 - DNA, 523 bp, Homo sapiens
  misc_feature: HEFZJCU01BXRT7.8.38.D05.1.454.heavy.3.raw
ctcgcgtgtccacgaccggtgctcgatttagtatctgatagttgggtttggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctacaaatggacagcctaagagttgaggacacggctgttattactgtacgaaaggaggggggaatacgagtggcgagctaccaagtacgtactttgacttcgtc

SEQ ID NO: 533797 - DNA, 491 bp, Homo sapiens
  misc_feature: HEFZJCU01E0GVC.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaagggctgggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgtagtttgtttgggcggatag

SEQ ID NO: 533798 - DNA, 539 bp, Homo sapiens
  misc_feature: HEFZJCU01B32R6.3.17.B06.1.454.heavy.3.raw
agacgcactccacgaccggtgctcgatttagtcgatagtgaagggggagagcggagccccagccccagaattcccaggtgttttcatttgatgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactctactttatctgcaaatgaacagcctgagaaccgacaacgacggccgtacttacttattgttgtctattacgacctagggacttaacaacggaacggttggtaaccctgggtttaacg

SEQ ID NO: 533799 - DNA, 521 bp, Homo sapiens
  misc_feature: HEFZJCU01BF93R.11.12.B01.1.454.heavy.3.raw
cgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtggagggggccagttccaccatctccagagacaactctaagaacacgctgtttcttcaaatgaacagcctgagagccgatgacacggccgtgtattactgtgcgagagagtcggggcccacggaaccgtttactaccgtactatcgggacgtcgt

SEQ ID NO: 533800 - DNA, 526 bp, Homo sapiens
  misc_feature: HEFZJCU01D5WZ3.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctgggggaggcttggtccagccgggggggtccctgagactctcctgtacagcctctggattcactctcggaaacttttggatggtctgggtccgccaggctccagggaaggggctggagtgggtggccaatatacagtcaggtggaggtacgatacactatctcgactctgtgaagggccggttcaccatctccagagacaacgccaagaattcactgtatctgcaaatgaacagcctgagagtcgaagacacgggttatttattattgtgtgcgagatctggatttccttcgaatgaagtgtggttcgtatgtgtttgattcg

SEQ ID NO: 533801 - DNA, 497 bp, Homo sapiens
  misc_feature: HEFZJCU01EO389.11.26.C04.1.454.heavy.3.raw
  modified_base (444)..(444): a, c, t, g, unknown or other
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggccgccctgctccaggagcacctccgagngcacagcggccctgggctgcctggtcaacggactacttcccgtacctcctcgt

SEQ ID NO: 533802 - DNA, 515 bp, Homo sapiens
  misc_feature: HEFZJCU01DFGRD.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctaggtggtcgataccatatactacgcagactctgtgaagggccgattcaccatctccagggacaacgccaagaactcactgactttgcaaatgacaccctgcgagccgaggacacggccgtatattactgtgcgagaataaccgttcgcctggttataccttgacacttgggccagggaacctggtcaccgtctcctcagcctccaccaagggcccagtcggtcttcccctcggccgccctgcctccaggacgcacctccgacgagcacagcggcccgtcggggcttcggcc

SEQ ID NO: 533803 - DNA, 536 bp, Homo sapiens
  misc_feature: HEFZJCU01ECXMU.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaagggctgaagtggtggcgtttattcatatgatggaactactcaacactatccagactccgggagggccgattccaccgtctccagagacaattccaagaacagggtgtttctccaagtgattgatctgagaagtggaggacacggcttgttttattactgtgcgcggtggctggaccgcttcttgacctacgtcgggggccggggagccccggtcagtccgtctccc

SEQ ID NO: 533804 - DNA, 529 bp, Homo sapiens
  misc_feature: HEFZJCU01DI5ZD.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtggggttggccggttctagagacacaactaacagtgacaccgcacaatacgccgcgtctgtgaaaggcagattcaccatctcaagagatgattcagagaactcactttatctgacaaatgaacagcctgagaaccgacgacacggccgtcgtattacttgtgttcattagacctaggataccaacgaccggtggtacctgggtattcc

SEQ ID NO: 533805 - DNA, 498 bp, Homo sapiens
  misc_feature: HEFZJCU01CRVAC.10.34.D01.1.454.heavy.3.raw
catagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccatattaaaatcaaagctgatggtgggacaacagagcacgctgcacccgtgaaaggcagattcagcatctcaagagatgattcaaaagtcgactgtatctgaacatgaacagcctgaaacggaggacacagccgtgtattactgtgcctactcaggaccgatattggt

SEQ ID NO: 533806 - DNA, 509 bp, Homo sapiens
  misc_feature: HEFZJCU01BUPBV.48.12.B01.1.454.heavy.3.raw
agtatacatacacgaccggtgctcgatttagtagtgtagattccgcgggcacgaccggtgctcgatttagcacacgatagttgggtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgagggccgattcgccttctccagagacaattccaagagcacggttcatctgcaaatgagcgccctgagacctgacgacacggctgtctattactgtgcgagagggcgtcgagtttaacacgccgtcgggagggatattacttttgacaacgtggggccacgggaaccctggtccaccgtctcctc

SEQ ID NO: 533807 - DNA, 506 bp, Homo sapiens
  misc_feature: HEFZJCU01DMRSN.51.71.G05.1.454.heavy.3.raw
cgatcgtatacacgaccggtgctcgatttagtgtcgtcgcaagagagaggggctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagccgtccaccaagggcccatccggtcttccccctggcaccctcctccaagacg

SEQ ID NO: 533808 - DNA, 521 bp, Homo sapiens
  misc_feature: HEFZJCU01B7UQM.40.9.A09.1.454.heavy.3.raw
tctagcgactcacgaccggtgctcgatttagcgagacgcgcaggggggtctcagagaggagccttagccctggactccaaggcctttccacttggtgatcagcactgagcacagaggactcaccatggaattggggctgagctgggttttccttgttgctattttagaaggtgtccagtgtgcggtgaaactagcggagtctgggggaggcttggtccagcctggggggtccctaagactctctgcgcagcctctggattcatgtttagtgattattggatggcttgggtccgtcaggctccagggaaagggctggagtttgtggccaagatgaaccacgacggaaatgagaaaaactatgcggactctgtgaagggccgattcaccatttccagagacaacgaccaagaagtcactctctctacacatgaccagcctgacagccgaggacacggctgtttattactgtgcgagagatggcacgtcggggcggtggactttgactactggggccaggggcc

SEQ ID NO: 533809 - DNA, 507 bp, Homo sapiens
  misc_feature: HEFZJCU01BPH4Z.53.81.H04.1.454.heavy.3.raw
cgcgtatacacacgaccggtgctcgatttagtagtgtagattcgcggggctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtgggtggcagttatatcatttgatggaagcacttacatactacgcaaactccgtgaagggccgattcaccatctccagagacgattccaggaacactctgtttctccaaatgaacagcctgagagctggaggacacggctactttattactgtgcgagagattctggattacagccaattatttaccg

SEQ ID NO: 533810 - DNA, 535 bp, Homo sapiens
  misc_feature: HEFZJCU01ERZ6P.14.25.C03.1.454.heavy.3.raw
  modified_base (282)..(282): a, c, t, g, unknown or other
  modified_base (337)..(337): a, c, t, g, unknown or other
  modified_base (502)..(502): a, c, t, g, unknown or other
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccgaagaacacgcagtatctgcaaatgaacngcctgagagctgaggacacggctgtgtattactgtgggagagatggaggtcgaanagtttgtagtgggtggtagcttgctataactggagtcgacccctggggccagggaacccgtggtcgccgtctccttccagcctccaccaacgggcccaacgtccggttcttcccccttcggccacccctcccgttccaacgaggcacccttcgtcgggggcaacncggccggcccgtcggggcctggcccttgggtcc

SEQ ID NO: 533811 - DNA, 473 bp, Homo sapiens
  misc_feature: HEFZJCU01D2EVN.19.71.G05.1.454.heavy.3.raw
  modified_base (349)..(349): a, c, t, g, unknown or other
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttganagtcgactgacaatcaacgtagacacatcgaagaaccagttctccctgcagctgacctctgtgactcccgaggacacgggtgtatattactgtggaagaggccccatagacatgccacctctct

SEQ ID NO: 533812 - DNA, 508 bp, Homo sapiens
  misc_feature: HEFZJCU01CEPDE.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctgggaggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactcgggggcccggagccctc

SEQ ID NO: 533813 - DNA, 551 bp, Homo sapiens
  misc_feature: HEFZJCU01DTWNV.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgtccgtttatttttgtacgagagcgtcgtctgtcagtggaattgactaccgtgggggtaccaggggaaccccttgggtcacccgtctcccttcagccctccacccgaacgggga

SEQ ID NO: 533814 - DNA, 521 bp, Homo sapiens
  misc_feature: HEFZJCU01COYSX.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccgggtgacgcctacggcagccggtcctttgacctttcgtggggggcccagggggaccg

SEQ ID NO: 533815 - DNA, 512 bp, Homo sapiens
  misc_feature: HEFZJCU01C9F1J.49.42.D09.1.454.heavy.3.raw
agtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaaggccgggggggtccctgagactctcctgtgcagcctctggattcaccttccgttcctataccatgaactggatccgccaggctccagggaggcgactggagtgggtctcatctattagtggtagaggtgattactacaactacgcagactcactggagggccgattcaccatctccagagacaacaccaagaatttactgtatctgcaaatggacagcctgagagccgacgacacggctgtctattactgtgcgagaggttcgggatattgccgtagtcccagatc

SEQ ID NO: 533816 - DNA, 521 bp, Homo sapiens
  misc_feature: HEFZJCU01EB6HW.9.34.D01.1.454.heavy.3.raw
tgatacgtctcacgaccggtgctcgatttagatcgtctgtgttgggtttggggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcaggtcgacactttgattactggggcccggggaaccctggtcgccgtctcctcagcctccaccaaggcccatcggtcttcccctggccacccgtcctccaagagcacctctgggggcacagcggcccgtgggctgcctgtcaaggactactccagacgtatca

SEQ ID NO: 533817 - DNA, 516 bp, Homo sapiens
  misc_feature: HEFZJCU01BV01T.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccgttcaccatctccagagacaatttccaagaaccacactgtatctgcaaatgaacagcctgagagccgacgacacggccatagtattactgtcgcgaaagcaccggcagttagtcacccatactactttggactactcggggaccg

SEQ ID NO: 533818 - DNA, 492 bp, Homo sapiens
  misc_feature: HEFZJCU01EDD38.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctggggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaatgaacagcctgagagctgaggacacggctgtgtattactgtgcgaagatttctata

SEQ ID NO: 533819 - DNA, 560 bp, Homo sapiens
  misc_feature: HEFZJCU01D5DRG.13.65.F10.1.454.heavy.3.raw
tcacgtactacacgaccggtgctcgatttagctacgctctaagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccagccgggggggtccctgagactctcatgtgcggcctctgggctcaccgtcaacaccaactacatgagctgggtccgccaggctccagggaagaggccggagtgggtctcagttatttatgtcgacggtgccacattctacgcagactccgtgagggggccggttcaccatctccagagacaattccaagaacacggtgtatcttcaaatgaacgacctgagagtcgaggacacggccgtctattactgtgacgaaagatgcagaggacggggcccccgtaaagtcgggggcctgggtgggagggtttcttcgtttgacgtgcgtcgggggccgaggggtaacccgtc

SEQ ID NO: 533820 - DNA, 498 bp, Homo sapiens
  misc_feature: HEFZJCU01DSAPT.17.10.A10.1.454.heavy.3.raw
  modified_base (435)..(435): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacaccccacgaacacagtctacatgcaactgacgagcctgagagctgacgacacggccgtntattactgtgcgagaatgttttctgtcatcgtacaattgatagctctatggatggacttcgtc

SEQ ID NO: 533821 - DNA, 533 bp, Homo sapiens
  misc_feature: HEFZJCU01EZ1HT.40.33.C11.1.454.heavy.3.raw
  modified_base (464)..(464): a, c, t, g, unknown or other
tctagcgactcacgaccggtgctcgatttagagtgagctcgttgggtttggggggaggccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatcctccagagacaacgccaagaacacagtgtctctgcaaatggacagtctgagagccgaggacacgggtgtctattattntacaaaagtggggactaatgaatatggtgtggacggtcgtcgggggccgaagggacaatagtctaccgg

SEQ ID NO: 533822 - DNA, 507 bp, Homo sapiens; identical to SEQ ID NO: 444486
  misc_feature: HEFZJCU01CK0R6.4.67.G01.1.454.heavy.3.raw

SEQ ID NO: 533823 - DNA, 533 bp, Homo sapiens
  misc_feature: HEFZJCU01B7G9S.40.20.B09.1.454.heavy.3.raw
tctagcgactcacgaccggtgctcgatttagtgtagtgtgaaggggagctctgagagaggagccttagccctggattccaaggcctatccacttggtgatcagcactgagcaccgaggagtcaccatggaactgggactccgctgggttttccttgttgcgattttagaaggtgtcaagtgtgaggtgcgactggtcgagtctgggggaggcctggtcaagccgggggggtccctgagactctcctgtgcagcctctggactcaccttcaggagtttcagtatgaattgggtccgccaggctccagggaaggggctggagtgggtctcatccatcagcagtggtagcacttacatacactatgcagactcagtgaagggccgattcaccatctccagagacacgccgggaactccctgtatctgacaaatgaagacgcctgcgaggccgacgggacacggggttgtttactttattgttaactaaagggacaaggaagggacgtttgggagtactacttacggtatacgggac

SEQ ID NO: 533824 - DNA, 527 bp, Homo sapiens
  misc_feature: HEFZJCU01ESAY5.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccagggggacctttggggtttcgacccctggggccagggaaccctggtcaccgtctcctcagcctccaccaagggcccatcggtctttccccctggccacctcctccaagagcacctcg

SEQ ID NO: 533825 - DNA, 527 bp, Homo sapiens
  misc_feature: HEFZJCU01BMCAB.52.67.G01.1.454.heavy.3.raw
cgcagtacgacacgaccggtgctcgatttagagtatacatattgggtttggggacccaacaaccacatccctcctcagaagccccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcgaccatcaccagggacacatccgcgagcacagcctacatggagttgagcagcctgagaaatgaagacacggctgtatattactgtgcgaggaaggggaaagtggacctccaccgaacgggaccctagtcggttccttcccccgtcggccacccctcctccc

SEQ ID NO: 533826 - DNA, 538 bp, Homo sapiens
  misc_feature: HEFZJCU01D2WQG.7.78.H01.1.454.heavy.3.raw
  modified_base (488)..(488): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgtccgtttatttttgtacgtagagcgtcgtctgtcagtggaattgactacnggggccagggaaccctggtccaccgtctcctcacgcctccaccgaggccc

SEQ ID NO: 533827 - DNA, 484 bp, Homo sapiens
  misc_feature: HEFZJCU01CI3BC.19.13.B02.1.454.heavy.3.raw
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgacaatgaacagcctgagagctgaggacacggctgtgtattactgcgcgaggcggt

SEQ ID NO: 533828 - DNA, 528 bp, Homo sapiens
  misc_feature: HEFZJCU01A7UCQ.7.71.G05.1.454.heavy.3.raw
  modified_base (449)..(449): a, c, t, g, unknown or other
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtntatactactgtacggaagggaggggggaaccgaggcgggagttccgaagtactcctttcgacgtcgtcgggggccgtac

SEQ ID NO: 533829 - DNA, 519 bp, Homo sapiens
  misc_feature: HEFZJCU01BK0ZE.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcgggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacaccgtccaagaaccagttctccctgaagctgagctctgtgaccgccgcagacacggctgtgtattactgtgcgagacagccaagacagtattttggagttggttactgttggacttactttgactacgtggggccaggggaacccctggta

SEQ ID NO: 533830 - DNA, 495 bp, Homo sapiens
  misc_feature: HEFZJCU01CWCJ3.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccccgagactctcctgtgcagcctctggattcaccttcagtacctatgctatgcactgggtccgccagggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatatttgta

SEQ ID NO: 533831 - DNA, 534 bp, Homo sapiens
  misc_feature: HEFZJCU01B03W5.17.25.C03.1.454.heavy.3.raw
cgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagcttacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatcgtgacgacaccgggccgtcgttattacctggttcgcgtaggacgttcccgaacgactcccggtggagacccgttaacggcacggcggttcccg

SEQ ID NO: 533832 - DNA, 506 bp, Homo sapiens
  misc_feature: HEFZJCU01BNW3E.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaacgaactcactgtatctgcaaatgaacagcctgagagccgaggacgacggctgtgtattactgtgcgagaggagctattatctcggaaccccgatgtt

SEQ ID NO: 533833 - DNA, 509 bp, Homo sapiens
  misc_feature: HEFZJCU01BRJS5.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatccggtgagcctacggcacggcggcctttgacctttcgtc

SEQ ID NO: 533834 - DNA, 547 bp, Homo sapiens
  misc_feature: HEFZJCU01C8D23.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaaattccgggaacacactgtctctgcaaaatgaacagcctgagagctgaggacagggctgtttattactgtgtgcgataccgacctcactggtacggggtagttacgttcctccgcaacggtatggacgtctggggccaagggaccacggtacaccgtctccttagtcctccaccaaagggcccactcggtccttccccctggccaccctcctccaagaggcacctcgtc

SEQ ID NO: 533835 - DNA, 515 bp, Homo sapiens
  misc_feature: HEFZJCU01B50M1.4.27.C05.1.454.heavy.3.raw
agcactgtagcacgaccggtgctcgatttagacgcgatcgaagggtttgggcacgaccggtgctcgatttagacgcgatcgaagggtttgggggggagaggagcccagcactgggattccgaggtgtttccattcggtgatcagcactgaacagagaggactcaccatggagtttttggctgagctgggttttccttgttgctactttaagaggagtccactgtggggtacagctgctggagtctggaggaggcatgatccagcctggggggtccctgagactctcctgtgcagcctctgggttcaccgtcacttacagccacatgagttgggtccgccaggctccagggaaggggctggagtgggtctcaggttctcataacgatggtactacatcgtactcagactccgtgaagggccgattcaccatctccagagacaattccaagaacatgttatcttcaatgtaatagactgcggcgaggacacggccgtctactactgtgcggaggggg

SEQ ID NO: 533836 - DNA, 507 bp, Homo sapiens
  misc_feature: HEFZJCU01D4Y4N.10.38.D05.1.454.heavy.3.raw
  modified_base (464)..(464): a, c, t, g, unknown or other
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatcgcacaatctgagagtcgacgacacggcccactattnttgtgtcgcgacatgactacgctcaattctggggccagggacg

SEQ ID NO: 533837 - DNA, 536 bp, Homo sapiens
  misc_feature: HEFZJCU01BRP10.17.28.C06.1.454.heavy.3.raw
  modified_base (523)..(523): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtagaaaaagtatggctgtgtttagttggggccagggancccgtggtcaccg

SEQ ID NO: 533838 - DNA, 510 bp, Homo sapiens
  misc_feature: HEFZJCU01A2E1O.21.61.F06.1.454.heavy.3.raw
  modified_base (455)..(455): a, c, t, g, unknown or other
tcgtcgctcgcacgaccggtgctcgatttagctacgctctaagggaaaggggacccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacaggcccctgggacaaggacttgagtggatgggatggatcagcgcttacaatggttacacaaactatgcacagaaactccagggcagagtcaccatgaccacagacacatccacgagcacagcctacatggagctgaggagcctgagatctgacgacacggcgtgtattactgtgcgnggaggctagcaggtcggtcccggttccgaccccgtcggggaccgacgggacccgt

SEQ ID NO: 533839 - DNA, 343 bp, Homo sapiens
  misc_feature: HEFZJCU01B8WTA.14.74.G08.1.454.heavy.3.raw
cgtctagtaccacgaccggtgctcgatttagtagctctatcagggagaactgcttcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctggggcacagcggccctgggctgcctggtcaaggactacttccgtactagacg

SEQ ID NO: 533840 - DNA, 495 bp, Homo sapiens
  misc_feature: HEFZJCU01DQUB9.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattacgtgttgggagagatgggaggtcgatattgt

SEQ ID NO: 533841 - DNA, 492 bp, Homo sapiens; identical to SEQ ID NO: 444695
  misc_feature: HEFZJCU01BS8J4.3.34.D01.1.454.heavy.3.raw

SEQ ID NO: 533842 - DNA, 529 bp, Homo sapiens
  misc_feature: HEFZJCU01CIWON.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctggggccatcggaacccggtcc

SEQ ID NO: 533843 - DNA, 514 bp, Homo sapiens
  misc_feature: HEFZJCU01C85B9.48.75.G09.1.454.heavy.3.raw
agtatacatacacgaccggtgctcgatttagtatagacatcagggggtacgtcctgtgccccaccatggacacactttgctccacgctcctgctgctgaccatccccttcatcgggtcttgtcccagatcacccttgaaggagtctggtcctacgctggtgaaacccacacagaccctcacactgacctgcaccttctcgggcttctcactcactcgtagtggggaggctgtggcctggattcgtcagcccccagggaaggccctggagtggcttgctctcatttactgggatactgatgaccgctacactccagctctgaaaacaggctcaccatcgccatggacacctccaaaaacaggtggtccttaaaatgaccaacatggacccaatggacagcgcgacatattactgtgcacacattgattgtggtcccaccaggtgtcccgggccctttgatatctggggccggggacattcgtcaccgtctctgcagcctccaccaagggcccacg

SEQ ID NO: 533844 - DNA, 512 bp, Homo sapiens
  misc_feature: HEFZJCU01EQ5MD.40.34.D01.1.454.heavy.3.raw
tctagcgactcacgaccggtgctcgatttagatcgtctgtgttgggtttgggggagtctccctcactgcccagctgggatctcagggcttcattttctgtcctccaccatcatgggggcaaccgccatcctcgccctcctcctggctgttgtccaaggagtctgtgccgaggtgcagctggtgcagtctggagcagaggtgaaaaagcccggggagtctctgaagatctcctgtaagggtttggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaacgtccgtcaataccgcctacctgcagtggagcagtctgcaggcctcggacaccgccatgtacttctgtgcgagagggttcggggatgactagtggggccagggaaccctggtccaccgtctctc

SEQ ID NO: 533845 - DNA, 504 bp, Homo sapiens
  misc_feature: HEFZJCU01B7Z4L.52.20.B09.1.454.heavy.3.raw
cgcagtacgacacgaccggtgctcgatttagtgtagtgtgaagggggctctgggagacgagcccagcactggaagtcgccggtgtttccattcggtgatcatcactgaacacagaggactcaccatggagtttgggctgagctgggttttcctcgttgctcttttaagaggcgtccagtgttatgtgcagctggtggagtctgggggaggtgtggtccagcctgggaggtccctgagactcgcctgtaaaccgtccggatttaccttcagtaactatgcaatgcactgggtccgccaggctccaggcaaggggctggactgggtggcagctatatcatttgatggaagcaataaatactacgcagactccgtgaagggccgattcaccatttccagagacagctccgataacacggtctatctgcgaatgaacagcctgagacctgaggacacggctctttttactgttgcgccaggaacgcagtggctcgggccacgactgat

SEQ ID NO: 533846 - DNA, 540 bp, Homo sapiens
  misc_feature: HEFZJCU01EF6T5.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaacggcagattcaccatctcaagagatgattacaaaaagcacgctgtatctgcaaatgaacagcctgagaaccgaggacacgagccgtgtattactgtaccacactcccctagaaagcgtacaactactactactacggtatggacctcgg

SEQ ID NO: 533847 - DNA, 497 bp, Homo sapiens
  misc_feature: HEFZJCU01CC988.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccagcagggggctggagtgggtggcagttatttcatatgatggaaatagtgacttctattcagactccgtgaagggccgattcacgtctccagagacaattccaggcacacgctgtatctgcaaatgaacagcctgagagctgagacacggctgtgtattactgtgacgaaagatttctatagaggtgactacggggggcgttcg

SEQ ID NO: 533848 - DNA, 539 bp, Homo sapiens
  misc_feature: HEFZJCU01ENC7W.17.28.C06.1.454.heavy.3.raw
  modified_base (500)..(500): a, c, t, g, unknown or other
  modified_base (526)..(526): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgaggagtcgcagacacgggccgtgtattactgtgcgagatgtggaaaaagtaanggctgtgtttattgggggcaggggancccgtggtctacc

SEQ ID NO: 533849 - DNA, 485 bp, Homo sapiens
  misc_feature: HEFZJCU01DO7AI.49.8.A08.1.454.heavy.3.raw
  modified_base (442)..(442): a, c, t, g, unknown or other
agtcgagagacacgaccggtgctcgatttagcatactctacagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagcaatatatactatgtagactcgtgaagggccgattcatcatctccagagacaattccgagaacacgctgtatctgacaaatgaacagcctgagngctgaggacacggctgtgtaattctagtgacgtaattaatacg

SEQ ID NO: 533850 - DNA, 505 bp, Homo sapiens
  misc_feature: HEFZJCU01DKOCT.47.55.E11.1.454.heavy.3.raw
agctcacgtacacgaccggtgctcgatttagcactcgcacgttgggtttgggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgttgttttcgatgtcctttcggtccggtcgggtacttcgt

SEQ ID NO: 533851 - DNA, 498 bp, Homo sapiens
  misc_feature: HEFZJCU01C85TM.49.47.E03.1.454.heavy.3.raw
agtcgagagacacgaccggtgctcgatttagactcgcgcacagagagaagggggcatcatccaacaaccacatcccttctctacagaagcctctgagagggaagttcttcaccatggactggacctggagggtcttctgcttgctggctgtagctccgggtgctcactcccaggtgcagttggtgcagtctggggctgaggtgaagaagtctggggcctcagtgaagatttcctgcaaggcttctggataccccttcaccatctaccacatgcactgggtgcgacaggccccgggacaagggcttgagtggatgggaataatcaaccctagtggtggtagcacaacctccgcacagaggttccagggcagagtcaccatgaccagggacacgtccacgagccacattctacatggaactgagccgcctgagatcgtgacgacacggccgttgtacctacgtgtcgcgaagacgtcactctatttactacgattaagtt

SEQ ID NO: 533852 - DNA, 504 bp, Homo sapiens
  misc_feature: HEFZJCU01D5ROA.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaaggcccatcggtcttcccctggcgccctcgctccacggagcacctccggagagcacagcggccctcgggctgcctcggtcaaggactacttccga

SEQ ID NO: 533853 - DNA, 489 bp, Homo sapiens
  misc_feature: HEFZJCU01DZOIT.53.56.F01.1.454.heavy.3.raw
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctgggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcagggtcaccatgaccagggacacgtccatcagcacagcctacatggagctacacggcctgagatctgacgacacggccctgttatttttgtgcgagagagtctaattaaagtggcttc

SEQ ID NO: 533854 - DNA, 497 bp, Homo sapiens
  misc_feature: HEFZJCU01D21XI.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatgtgatgggactgcctacgcacagaagtttcagggcagagtcaccatgaccagggacacgtccacgagaacagactatttggagttgagcagcctgagatactgacgacacggccgtttatactgtgcgcgagataatagtcacactaggaacggtcgtttgggtggtt

SEQ ID NO: 533855 - DNA, 517 bp, Homo sapiens
  misc_feature: HEFZJCU01CRVS1.52.83.H06.1.454.heavy.3.raw
cgcagtacgacacgaccggtgctcgatttagatcacgtgcgtcgcgggggggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaagtaacaaatactatgtagactccgtgaagggccgattcaccatctccagagacaattccaagaatacgctgtatctgcacatgacagcctgagagccgaagacacggggtgtttattactgtacgaacttaagttacggaggacaacgggtaacccccgtccgcacggcacc

SEQ ID NO: 533856 - DNA, 526 bp, Homo sapiens
  misc_feature: HEFZJCU01C4M39.10.79.H02.1.454.heavy.3.raw
  modified_base (348)..(348): a, c, t, g, unknown or other
  modified_base (509)..(509): a, c, t, g, unknown or other
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcntacatttatcctagtggtgataccatatactacgcagactctgtgaagggccgattcaccatctccagggacaacgccaagaactcactgactttgcaaatgaacaccctcgcgagccgaggacacggccgtatattactcgtgcgagaataacccgttcnccgtggttactttaccg

SEQ ID NO: 533857 - DNA, 538 bp, Homo sapiens
  misc_feature: HEFZJCU01AYFSR.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacgggcttatctgcagataaccaaccttcaacctgacgacactgccgtttatttttgttacgagagcgtcgtctgtcagtggaattgactacgtggggccagggaaccctggtcaccgtcctcctcacgcctccaccaacggg

SEQ ID NO: 533858 - DNA, 538 bp, Homo sapiens
  misc_feature: HEFZJCU01AXQRF.16.27.C05.1.454.heavy.3.raw
  modified_base (525)..(525): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccgggggagggccgattcaccgtctccagagacaattccaagaacagggtgtttctccaagtgattgatctgagaagtgaggacacggctgtttatactgtgcgcggtggctgaccgcttcttgacttactcggggggccggggaggcccccggtnactcgtcttcccg

SEQ ID NO: 533859 - DNA, 492 bp, Homo sapiens
  misc_feature: HEFZJCU01EVOYM.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacacagactccctgaggggccgattcaccatctccagagacaattcccaagaacacggtctatctgcacctgaccagcctgagaactgacgacacgtctctctactactgtgcgagagagttgacgagt

SEQ ID NO: 533860 - DNA, 506 bp, Homo sapiens
  misc_feature: HEFZJCU01C8577.18.50.E06.1.454.heavy.3.raw
  modified_base (440)..(440): a, c, t, g, unknown or other
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccggggggtcctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaatgaacagcctgacngtcgacgacacggccatgtatttttgtgtcgagcgacccggggctcctcaatggctttcatttacg

SEQ ID NO: 533861 - DNA, 529 bp, Homo sapiens
  misc_feature: HEFZJCU01B60LH.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttagttactgtgcgagagattcgagtggttcggggtaccgtcaccctggttcgttacttcgatctctggggtccc

SEQ ID NO: 533862 - DNA, 409 bp, Homo sapiens
  misc_feature: HEFZJCU01AUMB6.13.72.G06.1.454.heavy.3.raw
tcacgtactacacgaccggtgctcgatttagctacgactgcaagggaaaggggctgcagtgggtcgccactattggtgataatggcagaaacatttactacgcagactccgtgaggggccgcttcaccatctccagagacaattcacggaacacatttgtttttacaaaatttgtcggcctgcgggccgaggacacggccaaattatttttgtgtaaaggatcaatataccagtttggttcgaagtccgtggcctttttgactcctggggccagggaaccctggtcaccgtctcctcagcttccaccaagggcccatcggtcttccccctggcgccctgctccaggagcaccttctgggggcacagcggccctgggctgcctggtcaaggactacttccgtactagacg

SEQ ID NO: 533863 - DNA, 511 bp, Homo sapiens
  misc_feature: HEFZJCU01A82N4.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggacccg

SEQ ID NO: 533864 - DNA, 511 bp, Homo sapiens
  misc_feature: HEFZJCU01CNHPX.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatcccggtgacggcctacggcacggcggtcctttgaccttcgtc

SEQ ID NO: 533865 - DNA, 515 bp, Homo sapiens
  misc_feature: HEFZJCU01CCJ90.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcatacagtccgtctctgaagaacaggctcaccatcaccaaggacacctccacaaaccaggtggtccttacaatgaccaatatggaccctgtggacacagccacatattactgttcacgctctatgttcggggagttattagtccctactttgactactggggccagggaactctggtcaccgtctccgcagcctccaccaagggcccatcc

SEQ ID NO: 533866 - DNA, 522 bp, Homo sapiens
  misc_feature: HEFZJCU01DLNQB.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaacctatgcacagacgttccagggcagagtcaccattacccacagacacatccacgagcacagcctacatggacctgaggagcctgagatttgacgacacggccatatattactgtgcgagagattgggccgacggaaaccttgacctacgtgggggccaggggaaaccctcggtccaccggtt

SEQ ID NO: 533867 - DNA, 505 bp, Homo sapiens
  misc_feature: HEFZJCU01CIP69.53.1.A01.1.454.heavy.3.raw
  modified_base (345)..(345): a, c, t, g, unknown or other
cgcgtatacacacgaccggtgctcgatttagacgtctcatcagggggcatcacataacaaccagattcctcctctaaagaagcccctgggagcacagctcatcaccatggactggacctggaggttcctctttgtggtggcagcagctaccggtgtccagtcccaggtccacctggtgcaatccgggactgaggtgaagaagcctgggtcctcggtgaaggtctcctgcaaggcctctggagacaccttcaacagttatggtatcagttgggtgcgacaggcccctggacaagggcttgagtggatgggaaggatcatcccaatccttggtattacaaaaatcgnacagaggttcagggcagagtcctgttaaccgcggacaaatccactaccacagtctacatggagctgagcagcctgagatctgaagacacggcctgtactattgtgcgagagaaatgtacttctatgacagtactaatcaattactgtcttttagatgtcc

SEQ ID NO: 533868 - DNA, 541 bp, Homo sapiens
  misc_feature: HEFZJCU01BJAZO.13.24.C02.1.454.heavy.3.raw
tcacgtactacacgaccggtgctcgatttagtacagatcgttagggaaaggggctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcgggtccctgagactctcctgtgtagtttctgggctcacgtttgttgatcgtgccatgcactgggtccgccaaagtccagggaagggcctggagtgggtctcaggtatttatgggaacagtgaaagaatagggtatgcggactctgtgaagggccgattcaccatctccagagacaacgccaagaactccctcttttgcaatgaacagtctgaaaactgaggactcggccttatattactgtctcaaagaaagtaataaatgggggtctcggactacgtggggtccagggagccctggtcaccgtctcctc

SEQ ID NO: 533869 - DNA, 514 bp, Homo sapiens
  misc_feature: HEFZJCU01DQMVS.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggtttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaagggctggagtgggtaggtttcattagagccatggcttatgctgggacaacagaatacgccgcgtctgtgaaaggcaggattcatcatctcaagagatgattccaacggcatcgcctatctgcagatgaacagcctgaagaccgaggacacagccgtctattactgtgttagggtagtttacgtattttggtagtggatattaa

SEQ ID NO: 533870 - DNA, 525 bp, Homo sapiens
  misc_feature: HEFZJCU01C203X.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccagtccggtcttccccctggccg

SEQ ID NO: 533871 - DNA, 498 bp, Homo sapiens
  misc_feature: HEFZJCU01BI3NK.22.86.H09.1.454.heavy.3.raw
acatacgcgtcacgaccggtgctcgatttagtgctatagacttgggtttgggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatgggaaagtaataaagactatgtggactccgtgaagggccgattcaccatctccagagacaactccaagaacactctgtttctccaaatgaacagcctgagaggcgaggacacggcagtgtattactgtgcgagag

SEQ ID NO: 533872 - DNA, 524 bp, Homo sapiens
  misc_feature: HEFZJCU01DQO7X.13.4.A04.1.454.heavy.3.raw
tcacgtactacacgaccggtgctcgatttagagtagtgatcaggggtctgagagaggagcccagccctgggattttcaggtgttttcatttggtgatcaggactgaacagagagaactcaccatggaatttgggctgagctggctttttcttgtggctattttaaaaggtgtccagtgtgaagtgcagctggtggagtctggggggaggcttggtacagcctgggaggtccctgagactctcctgtgcagcctctggattcacctttagcaactatgccatgagctgggtccgccaggctccagggaaggggctggagtgggtctcaactattagtgctagtggtgccaccacatactacgcagactccgtgaagggccgattcaccatctccagagacaattccaagaacacgctgtatctgacaaatgaacagcctgagagccgaggaacacggcgtatattactgtgacggaaggtaactttaccctaattactttgactacgtggggccagggtaacccg

SEQ ID NO: 533873 - DNA, 545 bp, Homo sapiens
  misc_feature: HEFZJCU01EZCPI.52.34.D01.1.454.heavy.3.raw
cgcagtacgacacgaccggtgctcgatttagatcgtctgtgttgggtttgggctgagctggctctttcttgtggctattttaaaaggtgtccagtgtgacgtacagctggtggagtcggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgcgaaagatcgaggtcgcatgacagtttttggagtggccaaagacggcaggttccgcgtacgggttggacgtcgtggggccgaagggaccacggtcaccgtcgcctcagcctccaccaagggcccatcggtccttccccctggccaccctcctccaagag

SEQ ID NO: 533874 - DNA, 549 bp, Homo sapiens
  misc_feature: HEFZJCU01EL8HQ.18.33.C11.1.454.heavy.3.raw
tacgagtatgcacgaccggtgctcgatttagagtgagctcgttgggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtggtggggctaatttacttcgtaccccgtggggggcccgggggaacccgtggtccacccgtcctaccccacccctcccaacccg

SEQ ID NO: 533875 - DNA, 510 bp, Homo sapiens
  misc_feature: HEFZJCU01DI3AQ.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccgggtgacgtcctacggcaggcggccttttgactttcgtc

SEQ ID NO: 533876 - DNA, 400 bp, Homo sapiens
  misc_feature: HEFZJCU01CE6RS.12.72.G06.1.454.heavy.3.raw
atacgacgtacacgaccggtgctcgatttagctacgactgcaagggaaaggggctggagtgggtctcaggtattagtggaagtggagcaaccacatactacgcagactccgtaaagggccgattcaccatctccagagacaataccaacaacactctgtatctgcaactgaacggcctgagagccgaggacacggcccctttattactgtgcgaaagatcgggtaactttagcagcggctggttactttgactactggggccagggaaccctgggtcaccgtctccctcagcctccaccaagggcccatcggtcttccccctggcaccctcctccaagagcacctctgggggcacagcggccctgggctgcctggtcaaggactacttcctacgtcgtat

SEQ ID NO: 533877 - DNA, 506 bp, Homo sapiens
  misc_feature: HEFZJCU01C26UM.11.57.F02.1.454.heavy.3.raw
cgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgccaggctccaggtaaggggctggaatggatttcatacattagcagtagtggtgtgaccatatactacgcagactctgtgaagggccgattcatcatctccagagacaatggcaacaactcactgtatctggaaatcaacagcctgagagtcgaggacacgg

SEQ ID NO: 533878 - DNA, 472 bp, Homo sapiens
  misc_feature: HEFZJCU01CHM7N.16.71.G05.1.454.heavy.3.raw
  modified_base (385)..(385): a, c, t, g, unknown or other
  modified_base (438)..(438): a, c, t, g, unknown or other
tgtactactccacgaccggtgctcgatttagtgtcgtcgcaagagagaggggcccagcctgggattttcaggtgttttcatttggtgatcaggactgaacagagagaactcaccatggagtctgggctgagctggctttttcttgtggctattttaaaaggtgtccagtgtgaggtgcagctgttggagtctgggggaggctttgggcacagtcctgggggttccctgagactctcctgtgcacgcctctggattcacctttggacagctatgccatgacctgggtccgccaggctccagggaagggctggaatggggtctcaggtattactggtggttggttataccgacaatactacgcagactccgtgaaggccgttcaccnttctccagagactaatccaagaacacactgtatctgcaaatgaacaagctagngagccgacgacaacggccacgtatattactgtcg

SEQ ID NO: 533879 - DNA, 320 bp, Homo sapiens; identical to SEQ ID NO: 445022
  misc_feature: HEFZJCU01BEQ6D.14.28.C06.1.454.heavy.3.raw

SEQ ID NO: 533880 - DNA, 506 bp, Homo sapiens
  misc_feature: HEFZJCU01AXTI9.10.12.B01.1.454.heavy.3.raw
catagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaagggctggaatggatgacagttatttcacacgatgcaaccaaaacatactacgcggagttcgtgaggggccgctgcatcgtctccagagacaattcgaagaacactctgtacctgacaatagaacagtctgagagccgaggacgacggccgtctacttttgtgcgactagaaggtggagctagtaggggtatt

SEQ ID NO: 533881 - DNA, 538 bp, Homo sapiens
  misc_feature: HEFZJCU01BZ9U7.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgacaactttaatatgcactgggtgcgccgggctccaggcaaggggctggagtgggtgctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtcgtggggcaagggaccacggtcaccgtctccgttagcctccaccaacgggcccatcggtccttccccgtcggcaccctcctccaagagcacctcgtc

SEQ ID NO: 533882 - DNA, 521 bp, Homo sapiens
  misc_feature: HEFZJCU01B3QN4.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagagtggggcccacgaacgttactacgctatggacgtcgtggggccgaagggaccg

SEQ ID NO: 533883 - DNA, 516 bp, Homo sapiens
  misc_feature: HEFZJCU01EMV7Q.48.27.C05.1.454.heavy.3.raw
agtatacatacacgaccggtgctcgatttagacgcgatcgaagggtttggggtctgtgttgggtttggggggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtac

SEQ ID NO: 533884 - DNA, 509 bp, Homo sapiens
  misc_feature: HEFZJCU01BZXD5.21.23.C01.1.454.heavy.3.raw
tcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaatgaacagtctgagagccgaggacacggctgtgtattactgtgcaacggcccagaactggactacgccagtggacgtctggggcgaaac

SEQ ID NO: 533885 - DNA, 512 bp, Homo sapiens
  misc_feature: HEFZJCU01EIEPP.12.30.C08.1.454.heavy.3.raw
atacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtccccagggaagggcctggagtggattgggtacatctatcacagtgggagcacctactacatcccgtccctgaagagtcgaattacgatgtcagtaaacacgtctaggaaccagttctccctgaagctgaggtctgtgactgccgcagacacggccgtctactactgtgccaggtgggctttgcgccagtggttcagagatgatcgcttcgattcggtcggggccacggggatttccg

SEQ ID NO: 533886 - DNA, 508 bp, Homo sapiens
  misc_feature: HEFZJCU01AUUCL.53.55.E11.1.454.heavy.3.raw
cgcgtatacacacgaccggtgctcgatttagcactcgcacgttgggtttgggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagacccccgtgaagggccgattcaccatctccagacacaattccaagaacacactgtttcttcaaatggacttcctgagaactgaggacacggccgtgtattactgcgcgagagtgcatgatagtggtttccatgatgcttttgat

SEQ ID NO: 533887 - DNA, 512 bp, Homo sapiens
  misc_feature: HEFZJCU01EV9OA.4.81.H04.1.454.heavy.3.raw
agcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatcttcagggactttgacatgaattgggtccgccaggctccagggaaggggctggagtgggtctcatccatcagttccagtactcgttacatatactacgcagactcagtgaggggccgattcaccatctccagagacaacgccaagaactcagtgtttctgcaaatgaacagcctgagagtcgaggactcggctgtctactactgtgcgaggaataagggagctaccctacgtatttcggacacg

SEQ ID NO: 533888 - DNA, 511 bp, Homo sapiens
  misc_feature: HEFZJCU01EPUYV.11.57.F02.1.454.heavy.3.raw
  modified_base (465)..(465): a, c, t, g, unknown or other
cgagagataccacgaccggtgctcgatttagctcgatatagttgggtttgggggcagggtgtacacctgtggttctcggggctgccctttggctttggagatggttttctcgatggggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgccaggctccaggtaaggggctggaatggatttcatacattagcagtagtgtggcgaccatatactacgcagactctgtgaagggccgattcatcatctccagagacaatggcaacaacncactgtatctggaaatcaaacagcctgagagtcgaggacacggctt

SEQ ID NO: 533889 - DNA, 511 bp, Homo sapiens
  misc_feature: HEFZJCU01D4SA6.18.39.D06.1.454.heavy.3.raw
  modified_base (447)..(447): a, c, t, g, unknown or other
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgcctnctccaggagcacctcctggggcgacagcggccctcgggctgcctgtcaaggactacttccacta

SEQ ID NO: 533890 - DNA, 523 bp, Homo sapiens
  misc_feature: HEFZJCU01DDB1N.14.14.B03.1.454.heavy.3.raw
cgtctagtaccacgaccggtgctcgatttagtgtgagtagtttgggctgagctgggtcttccttgttgctattataaaaggtgtccagtgtcaagtgcagttggtggagtctgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgttttagaagttggggcttttgaccactgggccagggaaccctggtcaccgtctcttcagcctccaccaacgggcccagtccggtcttcccccgtggcaccctcctccaagagcacctccgtc

SEQ ID NO: 533891 - DNA, 516 bp, Homo sapiens
  misc_feature: HEFZJCU01CW6GD.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaacttcaacctgacgacactgccgtttatttttgtacgagagcgtcgtctgtcagtggaattgactactggggccagggaaccctggtcaccgtctcctcagcctccaccaagggcccatcggtcttccccctggccaccctcctccaagagcactctggggcacagcggcctggctgcctggtcaaggactacttcctagagacacg

SEQ ID NO: 533892 - DNA, 498 bp, Homo sapiens
  misc_feature: HEFZJCU01ENU52.49.15.B04.1.454.heavy.3.raw
agtcgagagacacgaccggtgctcgatttagacagtatatatccgcgggcacgaccggtgctcgatttagacgcgatcgaagggtttggggatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaagggcttctggagacaccttcaacaactttgctgtcagctgggtgcgacaggcccctggacaaggccttgagtgggtagggaaggatcacccctatccttaatatagcaaactatgcacagacattccacgacagagtcacccttatcgcggacaaatccacgaacacagcctacatggaactgcgcagcctaggatctgccgacacggccgtatatttctgtag

SEQ ID NO: 533893 - DNA, 513 bp, Homo sapiens
  misc_feature: HEFZJCU01A0FKJ.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagtttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccactattattggtgcgcgacatgactacgctcaattccgtggggtcccgagggaccg

SEQ ID NO: 533894 - DNA, 496 bp, Homo sapiens
  misc_feature: HEFZJCU01EU0YK.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttccccctggcaccctcctccaagagcacctctgggggcacagcggcctgggctgcctggtcaaggactacttccgagtagtaca

SEQ ID NO: 533895 - DNA, 495 bp, Homo sapiens
  misc_feature: HEFZJCU01CWO0V.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggtcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctcagagacaattccaagaacacgctgtatctgcaattgaacagcctgagagccgaggacacggccgtatattactgtgacgaaagagtttggggaatgaccacgtc

SEQ ID NO: 533896 - DNA, 518 bp, Homo sapiens
  misc_feature: HEFZJCU01C6WCM.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatcctccagagacttttctcagaacacactgtctcttcaaatgaacagcctgagggccgaggacacggccgtctattattgtgtgagagtttatggcgatggctgggtggacagatcacgtgggggccaac

SEQ ID NO: 533897 - DNA, 546 bp, Homo sapiens
  misc_feature: HEFZJCU01COB6A.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggtgagtggagtagaacgtaaatacggaaaccgtttgacgtttgggccgagggaaccctggtcaccgtctcctcagcctccaccgaacgggcccgatccgggtccttccccctcggtccaccctccctccaacgagccacctctgggggcacacgcggccctcgggctgcctc

SEQ ID NO: 533898 - DNA, 512 bp, Homo sapiens
  misc_feature: HEFZJCU01EUHVD.52.35.D02.1.454.heavy.3.raw
  modified_base (477)..(477): a, c, t, g, unknown or other
cgcagtacgacacgaccggtgctcgatttagcacacgatagttgggtttgggagatcatgagggtgtccctgagactctcctgtgcagcctctggattcagctttgatgagtatgccatgcactgggtccggcaggctccagggaagggcctggagtgggtctcaggtattagttggactagtggtagtataggctatggggcctctgtgaagggccgattcaccatctccagagacaacgccaagaactccctgtctctgcaaatgaacggactgagagttgaggacacgggcttctactattgtgcaaaaggccctgcccttttctatgatatcactgcttattactacacgcggttgactcctggggccagggaaccctggtcaccgtctcctcagcctccaccaacgggcccacgtcggtcttccccctggccaccctcctccaagagcacctcgtgggggcacagcgcccgngggctgcctggtacaaggactcttctatacgatcg

SEQ ID NO: 533899 - DNA, 544 bp, Homo sapiens
  misc_feature: HEFZJCU01A70HD.17.28.C06.1.454.heavy.3.raw
  modified_base (527)..(527): a, c, t, g, unknown or other
cgtagactagcacgaccggtgctcgatttagagctcacgtattgggtttggggaggtctcagagaggaggcttagccctggactccaaggcctttccacttggtgatcagcacttagcacagaggactcaccatggagttggggctgaactgggttttccttgttgctgttttagaaggtgtccagtgtgaggtccagttggttgagtccgggggaggcctggtccagcctggggggtccctgagactcctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtaatggctgtgtttattggggccaggggacncccgtaggtccaccgtt

SEQ ID NO: 533900 - DNA, 518 bp, Homo sapiens
  misc_feature: HEFZJCU01C1FZS.9.70.G04.1.454.heavy.3.raw
  modified_base (499)..(499): a, c, t, g, unknown or other
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtcctcaagagtcgagtcagcatgtcagtcgacacgtcccagaaccagttctccctgacagtgagttatatgaccgccgcagacacggccgtgtacttactgtgcgagagaggccgttatttaggaccagctgttaaaactcctactacggtctggacgtntgtggccgtaggggaaccg

SEQ ID NO: 533901 - DNA, 486 bp, Homo sapiens
  misc_feature: HEFZJCU01BMIB1.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacgacgggtgtatattactgtaggaaggaggccccataacg

SEQ ID NO: 533902 - DNA, 511 bp, Homo sapiens
  misc_feature: HEFZJCU01B68B7.22.11.A11.1.454.heavy.3.raw
  modified_base (480)..(480): a, c, t, g, unknown or other
acatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaattccaacnccggcgggggtcacccaaattagactactac

SEQ ID NO: 533903 - DNA, 524 bp, Homo sapiens
  misc_feature: HEFZJCU01DVZLD.48.25.C03.1.454.heavy.3.raw
agtatacatacacgaccggtgctcgatttagtagtgtagatttgggtttgggtgccttagccctggattccaaggcatttccacttggtgatcagcactgaacacagaggactcaccatggagctggggctgtgctgggtcttccttgttgcttttttagaaggtgtccagtgtgaggtgcatctggtggagtctgggggagccttggtgcagcctggagagtccctaagactctcctgcgcagcctcaggattcagtttcagtagttatgaaatgaattgggtccgccaggctccagggaagggactggagtggctttcatatattactggcagtgggtctcttacccattatgcagactctgtgaggggccgattcaccatctccagagacaaccccgaactctctttttctgcaaatggacagcctgacaggccgacgagtacggcctattttaattacttgtgcgagagagtcggggacccccgacactactccaaggaaggcacactcttacttttacg

SEQ ID NO: 533904 - DNA, 532 bp, Homo sapiens
  misc_feature: HEFZJCU01DC7UQ.49.30.C08.1.454.heavy.3.raw
agtcgagagacacgaccggtgctcgatttagtctgacgtcaaagggaaaggggactccaaggcctttccacttggtgatcagcactgagcacagaggactcaccatggagttggggctgagctgggttttccttgttgctattttagaaggtgcccagtgtgaggtgcagctggtggactcggggggaggcttggtccagcctgggggttccctgagactctcctgtgtagtctctggattcagctttaggagttattacatgagttgggtccgccaggctccagggaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtcggcccaaacccattacggagccgacgggaacccgtagttcgaagcggtcctcctctagccctccaacccg

SEQ ID NO: 533905 - DNA, 526 bp, Homo sapiens
  misc_feature: HEFZJCU01CWJGM.47.78.H01.1.454.heavy.3.raw
agctcacgtacacgaccggtgctcgatttagtgtgagtagtttgggtttggggctctgggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcatcataaagccgggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaaggcagattcaccatctccagagatgattcaaataaatatgtacatatctacaaatgatagcctagaaaatcgaggatacaggttagtttattactgttccaacagggaatggtcggttctcgtggggccgagggtaa

SEQ ID NO: 533906 - DNA, 515 bp, Homo sapiens
  misc_feature: HEFZJCU01DJ4T4.52.24.C02.1.454.heavy.3.raw
cgcagtacgacacgaccggtgctcgatttagtacagatcgttagggaaaggggctctgagagaggagccttagccctggattccaaggcctatccacttggtgatcagcactgagcaccgaggattcaccatggaattggggctccgctgggttttccttgttgctattttagaaggtgtccagtgtgaggtgcagctggtggagtctgggggaggcctggtcaagccgggggggtccctgagactctcctgtgcagcctctggattcaccttcagcagttatagcatgaactgggtccgccaggctccagggaaggggctggagtgggtctcatttattagtactagttacttatactacgcagactcagtgaagggccgattcaccatctccagagacaacgccaggaattcactatatttgcaaatgaacagccctgcgagccgaggacacggctgtgtattactgtgcgcgagaacacagcaatggcctatttcgacctacgtggggaccg

SEQ ID NO: 533907 - DNA, 534 bp, Homo sapiens
  misc_feature: HEFZJCU01A20PQ.49.81.H04.1.454.heavy.3.raw
agtcgagagacacgaccggtgctcgatttagtagtgtagattcgcgggggggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcacgtgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctggaagagctggacggacacggcttattttattactgtgcgtaaacttaatcacggaggacaaggggtcgacccccgtccaccgtcggtacggtaccg

SEQ ID NO: 533908 - DNA, 512 bp, Homo sapiens
  misc_feature: HEFZJCU01EUSOP.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaacctggtcaccgtctcctcagcctccaccaacgggcccatcggtcttcccctggccaccctcctccaagagcacctctgggggtcacgagcgcccgtggctgcctggtcaaggactactccgtactacg

SEQ ID NO: 533909 - DNA, 493 bp, Homo sapiens
  misc_feature: HEFZJCU01EO860.52.19.B08.1.454.heavy.3.raw
  modified_base (461)..(461): a, c, t, g, unknown or other
cgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgatcaggctgagagctgaagacacggcttttanatttactgtcgcgaaactttaatcgacgggaa

SEQ ID NO: 533910 - DNA, 541 bp, Homo sapiens
  misc_feature: HEFZJCU01BSQ3E.13.59.F04.1.454.heavy.3.raw
tcacgtactacacgaccggtgctcgatttagtacacacacttagggattgggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccagccgggggggtccctgagactctcatgtgcggcctctgggctcaccgtcaacaccaactacatgagctgggtccgccaggctccagggaagaggccggagtgggtctcagttatttatgtcgacggtgccacattctacgcagactccgtgagggggccgttcaccatctccagagacaattccaagaacacggtgtatcttcaaatgaacgacctgagagtcgaggacacggccgtctattactgtgcgaaagatgcagagacgggccccgtaagtggggcctggtggagggttcttcgtttgactgctggggcctaac

SEQ ID NO: 533911 - DNA, 520 bp, Homo sapiens
  misc_feature: HEFZJCU01BN93S.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttgggagtcagggaactctggtcaccgtctcctcagcctccaccaagggcccatcggtcttcccctggcgccctgctccaggacgcacctccgagacgacacagcggccccgtgggctc

SEQ ID NO: 533912 - DNA, 515 bp, Homo sapiens
  misc_feature: HEFZJCU01D0VZ9.7.28.C06.1.454.heavy.3.raw
  modified_base (337)..(337): a, c, t, g, unknown or other
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggngacctactatttggactctgtgaggggccgattcatcatctccagagacaacgccgacaactcactgtctctgctgatgagcagcctgagagccgacgacacggctatcctattactgtgacgaaactctcattccgttcatctgaatcgtggggccaggggaaccctggtccgcccg

SEQ ID NO: 533913 - DNA, 522 bp, Homo sapiens
  misc_feature: HEFZJCU01ADJGH.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcacgacaccggctgtgtattactgtgcggagggggccgggatattgttatagaaccacctgctatctgagtctggttcgactgcgtggggtaccgaggggaaccctggtcctaccg

SEQ ID NO: 533914 - DNA, 513 bp, Homo sapiens
  misc_feature: HEFZJCU01CQW7A.26.37.D04.1.454.heavy.3.raw
agactatactcacgaccggtgctcgatttagtagcatactgttgggtttggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggagcaggtagtggagtctgggggaggcgtggtccagcctggggggtccctgagactctcctgtgcagcctctggattcacctttcagtacctacgccatgcactggatccgccaggctccaggccaaggggctagagtgggtggctcttatatcatatgatggaagtaatgaacattacgcagactccgtgaagggccgattcaccgtctccagagacaattccaagagcacgatgtttctgcaaatgaacagcctgagagttgaggacgacgggtgtcttatttctgttgcgcgaggtccgggtggaggggtgtcctacg

SEQ ID NO: 533915 - DNA, 504 bp, Homo sapiens
  misc_feature: HEFZJCU01A15P3.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccgacggaccacccccacgaaccacagtctacatgcaactgacgagcctgagagctgacgacacggccgtctattactgtgcgagaatgttttctgtcatcgtacatttgataggctctatggactggacttcgtc

SEQ ID NO: 533916 - DNA, 507 bp, Homo sapiens
  misc_feature: HEFZJCU01B2VAC.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcgtgaactgggtccgccaggctccagggaaggggctggagtgggtctcatccattagtagtagtagtagttacatatactacgcagactcagtgaagggccgattcaccatctccagagacaacgcaagaactcactgtatctgcaatgaacagctgagagcgaggacacggctgtgtattactgtgcgagtttggtttgggtcgggagtagcagacggaccggggggt

SEQ ID NO: 533917 - DNA, 514 bp, Homo sapiens
  misc_feature: HEFZJCU01BM8NL.48.23.C01.1.454.heavy.3.raw
agtatacatacacgaccggtgctcgatttagtacacgtgattagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctgggagtgggattggggagtatttaccacagtgggagcacctactacaacccgtccctcaaaagtcgaggcaccatatccgtagacacgtccaagaaccaattctccctcgaagctgagctctgtgaccgccgcagacacggctgtctattactgtgcgaggccccgagcgcagtggcttttgtatgtccttgtactatgtggggccaaggggacaactggtcgaccgtt

SEQ ID NO: 533918 - DNA, 524 bp, Homo sapiens
  misc_feature: HEFZJCU01B3L2Y.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggaccaatactatgggggcttgttctggggccaggggaccctggtcatcgtctccccagcctccaccaaggcccatccggtcttccccctggccg

SEQ ID NO: 533919 - DNA, 535 bp, Homo sapiens
  misc_feature: HEFZJCU01DK8XR.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatcctccagagacaactctaagacacgctgtttcttcaatgaacagcctgagagccgatgacacggccgtgtattactgtgcgagagatgggggcccacgtaacgttaactcgactagtggacgtcgtgggggaccaaggggacctacc

SEQ ID NO: 533920 - DNA, 528 bp, Homo sapiens
  misc_feature: HEFZJCU01ERLTH.48.42.D09.1.454.heavy.3.raw
agtatacatacacgaccggtgctcgatttagacacatacgcagggaaagggggctttctgagagtcagggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggttggatccgccagcccccagggaaggggctggagtggattggggagtatgcactatagtgggagcacccactacaccccgtccctcaagagtcgagtcaccatatccgtagacacgtccaagatcagttctcctgaagctgacctctgtgaccgccgcagacacggctgtttattactgtgtgaggacgggtgccccaaagaaaaagtgttttattccctggggccaggggaaccctggtcaccgtctcctcacgcctccaccaacgggcccct

SEQ ID NO: 533921 - DNA, 500 bp, Homo sapiens
  misc_feature: HEFZJCU01DY17A.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtactattgataggtctctatggactggacttctc

SEQ ID NO: 533922 - DNA, 503 bp, Homo sapiens
  misc_feature: HEFZJCU01AJOZF.3.67.G01.1.454.heavy.3.raw
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgacaatgaacagcctggaagacgcggacacagccatgtatttattgtacattaggacactatacg

SEQ ID NO: 533923 - DNA, 548 bp, Homo sapiens
  misc_feature: HEFZJCU01ALHAS.18.78.H01.1.454.heavy.3.raw
tacgagtatgcacgaccggtgctcgatttagtgtgagtagtttgggtttggggctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaggctggagtgggttggccgtattagaagcaaagctaacagttacgcgacagcatatgctgcgtcggtgaaaggcaggttcaccgtctccagaaatgattcaaagaacacggcgtatctgcaatgaacagcctagaaaaccgaggacgacggccgtgtattactgtactagacaggtggattactagtttggggggtagttagtcgacgaaacgggggggtactacgtacgtacg

SEQ ID NO: 533924 - DNA, 513 bp, Homo sapiens
  misc_feature: HEFZJCU01CEZES.3.81.H04.1.454.heavy.3.raw
  modified_base (444)..(444): a, c, t, g, unknown or other
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgagggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtctcccctgcgcctgctcaggngcactccgagagcacagcggccctcgggcgtcgcctggtcgaacggactaccttcccgagtgccggtct

SEQ ID NO: 533925 - DNA, 501 bp, Homo sapiens
  misc_feature: HEFZJCU01D89I7.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaaatagtgacttctattcagactccgtgaagggccgattcgaccgtctccagagacaattccaggcacacgctgtatctgcaaatgaacagcctgagagctgaggacacggctgtgtattactgtgcgaaagatttctatagaggtgactacggggggcgttcg

SEQ ID NO: 533926 - DNA, 514 bp, Homo sapiens
  misc_feature: HEFZJCU01DF08Q.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctgggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgagggccgattcatcatctccagagacaacgccgacaactcactgtctctgctgatgagcagcctgagagccgacgacacggctatctattactgtgcgaaactctcattccgttcatctagaatactggggccagggaacccctggtccgtccg

SEQ ID NO: 533927 - DNA, 500 bp, Homo sapiens
  misc_feature: HEFZJCU01D5TCJ.15.34.D01.1.454.heavy.3.raw
tctacgtagccacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagggtgaggtgcaggtggtggaatctgggggaggcttggtccagcctggggggtccctgagactctcctgtgcagcctctggattcagttctagtaaatactggataagttgggtccgccaggctccagggaaggggctggagtggatggccaatatgaaccaagacggaagtgataaacatcatgtgggctctgtgcagggccgattcactatctccagagacaacgccaagaatctagtgtatttgtcaaatagaacaagcctgagagccgacgacacggctgtgtattactgtgcgggagggccggagtggtattgg

SEQ ID NO: 533928 - DNA, 553 bp, Homo sapiens
  misc_feature: HEFZJCU01ETWLQ.51.5.A05.1.454.heavy.3.raw
cgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctacggagaccctgtccctcagctgcgctgtatatcgtgggtccttcagtggttactactggagctggatccgccagtccccaggggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtcgcgtagactcgcccgggttcctcggctaccgtcgttggtcggcccctaaagttttcgggttttaaccgggcaacgacaaaactacgacgggcgtaacgtacctacggaccggtacgtcgggtacc

SEQ ID NO: 533929 - DNA, 516 bp, Homo sapiens
  misc_feature: HEFZJCU01AU7GJ.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggagtcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcggtcctttgacttactcggggctggggactctggtcaccgtct

SEQ ID NO: 533930 - DNA, 530 bp, Homo sapiens
  misc_feature: HEFZJCU01AJXJF.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatccggtcttcccctcggccgccctcg

SEQ ID NO: 533931 - DNA, 493 bp, Homo sapiens
  misc_feature: HEFZJCU01EEGST.48.12.B01.1.454.heavy.3.raw
agtatacatacacgaccggtgctcgatttagtagtgtagattccgcgggcacgaccggtgctcgatttagcacacgatagttgggtttggggatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacaccggccgtcgtattt

SEQ ID NO: 533932 - DNA, 504 bp, Homo sapiens
  misc_feature: HEFZJCU01D6CBV.47.85.H08.1.454.heavy.3.raw
  modified_base (501)..(501): a, c, t, g, unknown or other
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagtttgacgagtcattgtgagcttgactcctggggccagggaaccctggtcatcgtctcctcagcctccaccaacgggcccatcggtcttcccctggccgccctgctccaggacgcacctccgagaagcacagcggccctcggcgtgcctggtcgaaggactacttcctacgtgtagctcgtnacg

SEQ ID NO: 533933 - DNA, 489 bp, Homo sapiens
  misc_feature: HEFZJCU01CNCFM.49.59.F04.1.454.heavy.3.raw
agtcgagagacacgaccggtgctcgatttagtacacacacttagggattggggagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacaagtctgagacgtgaagacgacggctgtctattactgtgtcgactgagatagtcttattacgatgcc

SEQ ID NO: 533934 - DNA, 532 bp, Homo sapiens
  misc_feature: HEFZJCU01AVNIS.48.86.H09.1.454.heavy.3.raw
agtatacatacacgaccggtgctcgatttagtgctatagacttgggtttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggagttgggagtatttaccacagtgggagcacctactacaacccgtccctcaaaagtcgaggcaccatatccgtagacacgtccaagaaccaattctccctgaagctgagctctgtgaccgccgcagacacggctgtctattactgtagcgaggcccgagcgcagtggtactttttgattgtcccgtttgtacttatggtgggggtcccgaaggggaaccgaaatgggtccgaccggttccc

SEQ ID NO: 533935 - DNA, 529 bp, Homo sapiens
  misc_feature: HEFZJCU01B5XTR.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctgggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataacccaaccttccaacctgacgacactgtccgtttatttttgtacgagagcgtcgtctgtcagtggaattgactactgggccagggaccctggtcaccgtctcctcagcctccacc

SEQ ID NO: 533936 - DNA, 509 bp, Homo sapiens
  misc_feature: HEFZJCU01AGD37.17.25.C03.1.454.heavy.3.raw
  modified_base (459)..(459): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagngtcccacgatccggtgagcctacggcaggccggccttttggacctttgtc

SEQ ID NO: 533937 - DNA, 529 bp, Homo sapiens
  misc_feature: HEFZJCU01BOWBI.51.26.C04.1.454.heavy.3.raw
cgatcgtatacacgaccggtgctcgatttagtctagcgactttgggtttggggggggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgaccctcacgtgggtacggggtagtttacttcctccgacgaacggtatcggacgtc

SEQ ID NO: 533938 - DNA, 526 bp, Homo sapiens
  misc_feature: HEFZJCU01CZ9PM.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttggggtttcgacccctggggccagggaaccctggtcaccgtctcctcagcctcaccaagggcccatcggtcttccccctggccacctcctccaagagcacctcg

SEQ ID NO: 533939 - DNA, 403 bp, Homo sapiens
  misc_feature: HEFZJCU01EYTXO.3.85.H08.1.454.heavy.3.raw
  modified_base (330)..(330): a, c, t, g, unknown or other
agacgcactccacgaccggtgctcgatttagtatcactcagtcgcggggagctctgagagaggagcccagccctgggattttcaggtgttttcatttggtgatcaggactgaacagagagaactcaccatggagtttgggctgagcgtggtcgttttcttaggtggctaatttttaaaaggtgtccagtgtgaggtgcagctggtggagtctggggaggcttggtacagcctgggggtccctgagactctcctgtgcagcctctggattccacctttagtaattatgccattgacgctgggtccgccgaggctccagggaaggggctggngtgggttctcagctattagtgatgtggtggtaaccacatactacgcacgactccggtgaagggcccgtcttcc

SEQ ID NO: 533940 - DNA, 344 bp, Homo sapiens
  misc_feature: HEFZJCU01C7X33.52.78.H01.1.454.heavy.3.raw
cgcagtacgacacgaccggtgctcgatttagtgtgagtagtttgggtttggggctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggaatgacttgggtccgccaggctccagggaaggggctggagtgggtggccagcgtgaagca

SEQ ID NO: 533941 - DNA, 517 bp, Homo sapiens
  misc_feature: HEFZJCU01D99ZP.40.31.C09.1.454.heavy.3.raw
tctagcgactcacgaccggtgctcgatttagacgtctcatcaaggaaggaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtcgaccgccgcagacacggctgtctattactgtgcgacggccccgagcgcagtggtcttttgtatgtcttgtatatgtggggcgaagggacaagtgtcgtaccgtctcttcacgtcctccaccgaacc

SEQ ID NO: 533942 - DNA, 490 bp, Homo sapiens
  misc_feature: HEFZJCU01BMM3M.10.85.H08.1.454.heavy.3.raw
catagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttccccctggccgccctgctccaggagcacctccgagagcacagcggccctgggctgcctggtcaaggactacttcccactacctatg

SEQ ID NO: 533943 - DNA, 494 bp, Homo sapiens
  misc_feature: HEFZJCU01CPN5B.49.34.D01.1.454.heavy.3.raw
agtcgagagacacgaccggtgctcgatttagatcgtctgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattaccaagaacaccccactatatcttcaaatagaacactctgagacgtgaggacacggctgtctattactgtgcgactgagatgtctt

SEQ ID NO: 533944 - DNA, 498 bp, Homo sapiens
  misc_feature: HEFZJCU01E1S9B.51.71.G05.1.454.heavy.3.raw
cgatcgtatacacgaccggtgctcgatttagtgtcgtcgcaagagagagggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatgggaagcaataagcactacgcagagtccgtggaagggccgattgaccatctccagagacaactcgaagaatacggttcttctacaatagaacagctgagagctgaggacacggctatgttttactgtgcgagagggaactcgtattac

SEQ ID NO: 533945 - DNA, 496 bp, Homo sapiens
  misc_feature: HEFZJCU01CJL6V.13.71.G05.1.454.heavy.3.raw
tcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggagcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaaattctatgcagactccgtgaagggccgattcaccgtctccagggacaactccaagaacaccttatatctgcagatgaacagcctggagaggtgacggactcggctgtatacttctgtcgcgacaaacatagatgtttggagtggatgtgtta

SEQ ID NO: 533946 - DNA, 502 bp, Homo sapiens
  misc_feature: HEFZJCU01DACIL.17.10.A10.1.454.heavy.3.raw
  modified_base (458)..(458): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggccccggacaagggcttgagtgggtggggtgggtcagcggcttgacggtaaggcacagtatgcaccgaagatgaagggcagagtcacgattaccacggacacccccacgaacacagtctacatgcaactgacgagcctgagagctgacgacgacggccgtctattactgtgcgagaatgttttntgtcatcgtactaattgagtaggctctatggtactggacttgtc

SEQ ID NO: 533947 - DNA, 511 bp, Homo sapiens
  misc_feature: HEFZJCU01DJJ5O.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtggtattactgtgcgcgacaggtggacgtctggggccaagggaccacggtcaccgtctcctcagcctccaccaagggccccatcc

SEQ ID NO: 533948 - DNA, 523 bp, Homo sapiens
  misc_feature: HEFZJCU01BG9VE.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcacgcctccaccaacgggcccatcggtcttcccctggccaccctcctccaagagcacctctgggggcacagcggccctgggctgcctggtcaaggactactccgagtacgtacacg

SEQ ID NO: 533949 - DNA, 508 bp, Homo sapiens
  misc_feature: HEFZJCU01DTWCT.10.38.D05.1.454.heavy.3.raw
  modified_base (477)..(477): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagtttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatattgtatcttcacatgcacaatctgagagtcgacacacggccactattattgtgcgcgacatnactacgctacattcgtaggggccagggaccg

SEQ ID NO: 533950 - DNA, 510 bp, Homo sapiens; identical to SEQ ID NO: 480169
  misc_feature: HEFZJCU01DOPRX.17.25.C03.1.454.heavy.3.raw

SEQ ID NO: 533951 - DNA, 530 bp, Homo sapiens
  misc_feature: HEFZJCU01BFLQR.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagaggagacacacgaacctactggccaatactatgggggcttgttctggggccaggggaccctgggtcatcgtctccccagcctccaccaaggggccccagtccggttcttccccctggccg

SEQ ID NO: 533952 - DNA, 517 bp, Homo sapiens
  misc_feature: HEFZJCU01CNP51.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctgggagtgggtggccaacataaatgacgatgcaaaggagacctactatttggactctgtgaggggccgattcatcatctccagagacacgccgacaactcactgtctctgctgatgagcagcctgagagccgacgacacggctatctattactgtgcgaaactctcacttccgttcatctagaatacgtggggccgagggaacccgtggtccgtccg

SEQ ID NO: 533953 - DNA, 517 bp, Homo sapiens
  misc_feature: HEFZJCU01A7L2R.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggcaagggacaatggtcaccgtctcttcagcctccaccaagggcccatcggtccttcccctggccaccctccctccaagagcacctcgtggggcacagcggcccg

SEQ ID NO: 533954 - DNA, 537 bp, Homo sapiens
  misc_feature: HEFZJCU01D44P5.18.59.F04.1.454.heavy.3.raw
  modified_base (486)..(486): a, c, t, g, unknown or other
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattcaccatctcaagagatgattcaaaaagcacgctgtatctgcaatgaacagcctgagacgaggacacagccgtgtattactgtaccacatccctnaaagcgtcaactactactactacggtatggacctcgtgggccaacggaccg

SEQ ID NO: 533955 - DNA, 510 bp, Homo sapiens
  misc_feature: HEFZJCU01C6KBL.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatcgaccacgaactcctccaataaacacagcctacatggagttgaggagcctgacatctgacgacacggcctctattactgtgcgagacgtcccagatccggtgacgtccacggcaggccggtcctttgaccttcgtc

SEQ ID NO: 533956 - DNA, 502 bp, Homo sapiens
  misc_feature: HEFZJCU01B0P3Y.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctactgacacgacggcatgtattactgtggaagagacgttggtgcgtaccggcggggctgaccagtcggggccg

SEQ ID NO: 533957 - DNA, 528 bp, Homo sapiens
  misc_feature: HEFZJCU01D2XXM.13.37.D04.1.454.heavy.3.raw
tcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatactctgcagatgaacagacccgtgggacgccggaaggacgaccgggtaccgttttactctacgtgtgacgaaagataattagtaatgagtggtagtctgta

SEQ ID NO: 533958 - DNA, 526 bp, Homo sapiens
  misc_feature: HEFZJCU01DP4ZJ.12.40.D07.1.454.heavy.3.raw
  modified_base (493)..(493): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacaacgaacctactggccaatactagtgggggcttgttctggggccaggggaccctggtcatcgtactccccagccnccaccaacggcccatcggtccttcccctggccg

SEQ ID NO: 533959 - DNA, 519 bp, Homo sapiens
  misc_feature: HEFZJCU01C3EGN.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctctttttatttatagtagtggtagtacatctccgcagactccgtgaggggccgattcaccatctccagagacaattccaagaacacgctgtttcttcaaatgaacagcctgagagccgatgacacggccgtgtattactgtgcgagagagtggggcccacggacgtttactacgctatggacgtctggggccaaggggta

SEQ ID NO: 533960 - DNA, 527 bp, Homo sapiens
  misc_feature: HEFZJCU01C7OBS.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacattgagctgggtccgccaggctccaggggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcgggggtcacccaaattagactactgggggccagggaaccctggtcatcgtctcctcagcctccaccaacggcccatcgtccttcccctggccgccctgctcc

SEQ ID NO: 533961 - DNA, 520 bp, Homo sapiens
  misc_feature: HEFZJCU01A573Q.47.55.E11.1.454.heavy.3.raw
  modified_base (461)..(461): a, c, t, g, unknown or other
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaagggctggtgtgggtctcacgtatcaatcctgatggcagtgttataaattatgcggactccgtggaggggccgattccagcatctccagagacaacggcaagagtatactgtatctaggaaatgaaacaatctgagagtcgacgatacggctcgtntatcattgtgttttcgatcgtccttccggtccgtcgggactttcgtcggggtccgaacc

SEQ ID NO: 533962 - DNA, 513 bp, Homo sapiens
  misc_feature: HEFZJCU01ASG9B.19.86.H09.1.454.heavy.3.raw
tactctcgtgcacgaccggtgctcgatttagtgctatagacttgggtttgggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgaccctggggccagggaaccctggtcaccgtctcctcagcctccaccagggcccatcggtcttcccctggccgccctgcctcaggagcacctccgagagcacagcgg

SEQ ID NO: 533963 - DNA, 523 bp, Homo sapiens
  misc_feature: HEFZJCU01C4IL1.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggtccgattcaccatcctccagagacaattccaagaacacgctgtttcttcaaatgaacagcctgagagccgatgacacggccgtgtattactgtgcgagagatggggcccacgaacgttactacgctatggacgtcgtggggccgaagggaccg

SEQ ID NO: 533964 - DNA, 500 bp, Homo sapiens
  misc_feature: HEFZJCU01ASEIZ.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagagtacgggcagcacggtggtttggggctacgtgggcacgggaacccgtggtccaccgtctcctcagcctccaccg

SEQ ID NO: 533965 - DNA, 499 bp, Homo sapiens
  misc_feature: HEFZJCU01B4F0M.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctacattctggggcc

SEQ ID NO: 533966 - DNA, 489 bp, Homo sapiens
  misc_feature: HEFZJCU01B6G8M.48.38.D05.1.454.heavy.3.raw
agtatacatacacgaccggtgctcgatttagtatctgatagttgggtttggggatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctgggacaaggtcttgagtggatgggagtaatcgtcccttcttcaactagaacgcactacgcacagaagttcgaggacagagtcacatttatggtggataaagccacgagcacagtctacatgcagctgagcagccctggagacacaacgacacggccgtctatttattgttcctagagataaatcgcgtgaataaagat

SEQ ID NO: 533967 - DNA, 525 bp, Homo sapiens
  misc_feature: HEFZJCU01ALSMF.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctgggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgaacgacacgggccgtctacttacgtgtgcgagaacttggtttttctggtctatcgtacgtaaattttgaagtaggcttctatggtaacctgggtacttcgtc

SEQ ID NO: 533968 - DNA, 504 bp, Homo sapiens; identical to SEQ ID NO: 445648
  misc_feature: HEFZJCU01B844N.17.25.C03.1.454.heavy.3.raw

SEQ ID NO: 533969 - DNA, 503 bp, Homo sapiens
  misc_feature: HEFZJCU01CEQ91.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcaagggcagggtcaccgatgaccaagggagacgtccgtcaggacagcctatatggaggtgaccagcctgagccctgacgacacggccatatatttctgtgcgcgaggaattcgacttctggaatatacttgggttggaactactta

SEQ ID NO: 533970 - DNA, 492 bp, Homo sapiens
  misc_feature: HEFZJCU01DLJJB.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttcccctggcaccctcctccaagagcacctcgtgggggcacagcggccctgggctgcctggtcaaggactacttccgtatctctcg

SEQ ID NO: 533971 - DNA, 489 bp, Homo sapiens
  misc_feature: HEFZJCU01EA3PM.10.38.D05.1.454.heavy.3.raw
  modified_base (425)..(425): a, c, t, g, unknown or other
  modified_base (464)..(464): a, c, t, g, unknown or other
catagtagtgcacgaccggtgctcgatttagtatctgatagttgggtttgggggggagaggagcccagcactgggattccgaggtgtttccatttcggtgatcagcactgaacacagaggactcaccatggagtttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctcagggaaggggctggagtgggtctcagttattgaaacagatggcactacatattattctgactccgtgaagggccggttcaccctctccagagacacttccaacacatctgtatcttcanatgcacatctgagagtcacgacacggccacctattattntgcgcgacatgactacgctcattcc

SEQ ID NO: 533972 - DNA, 505 bp, Homo sapiens
  misc_feature: HEFZJCU01A35QY.17.10.A10.1.454.heavy.3.raw
  modified_base (461)..(461): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagtaatgttttcngtcatcgtacaatttgataggctctatggactggtacttcgtac

SEQ ID NO: 533973 - DNA, 530 bp, Homo sapiens
  misc_feature: HEFZJCU01EBJDS.53.33.C11.1.454.heavy.3.raw
  modified_base (211)..(211): a, c, t, g, unknown or other
cgcgtatacacacgaccggtgctcgatttagagtgagctcgttgggtttgggctgagctgggttttcctcgttgctcttttaagaggtgtccagtgtcacgtgcagctggtgcagtctggggggaggcgtggtccagcctgggaggtccctgaaactctcctgtgcagcctctggattcgtctcaagtgtctaccctttgcactgggtccnccaggctccaggcaaggggctggagtgggtggcacttatctcatctgatggaagagatgcctattacgcagactccgtgaagggccgattcaccatctccagagacaattccaagaacacactgtatctgcaaaatggacagcctgagagctgaagacacggctgtgtattactgtgcgagtgagatgtcttactatgatgccagtgggtttggttaccgttccgaccccgttcgggggccagggaacccgtggtccaccgtccgtcctccagtccttccaccaacgggcccagtcggtccttcccctcggccgtcccg

SEQ ID NO: 533974 - DNA, 532 bp, Homo sapiens
  misc_feature: HEFZJCU01D85YE.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgccaggctccagggaaggggctggagtgggtggccaacataaagtacgatgaagttgagataaattatttggactctgtgaagggccgattcaccatctcgagggacaacgccaagaactcgctgtatctgcaaatggagagcctgagagccggaggacacggctgtatattattgtgtgagattagcgcacttactttgactacgtggggccagggaaccctggtcaccgt

SEQ ID NO: 533975 - DNA, 505 bp, Homo sapiens
  misc_feature: HEFZJCU01BJXLE.47.48.E04.1.454.heavy.3.raw
  modified_base (463)..(463): a, c, t, g, unknown or other
  modified_base (473)..(473): a, c, t, g, unknown or other
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaaggccgattcaccatctccagagacaacgccaagaactctctgtttctgcaaatggacagcctgagagtcgaagacacggctgtntattactgtntgtctctgacgcctcggccggacctggcttcg

SEQ ID NO: 533976 - DNA, 502 bp, Homo sapiens
  misc_feature: HEFZJCU01BUED2.40.86.H09.1.454.heavy.3.raw
tctagcgactcacgaccggtgctcgatttagtgctatagacttgggtttgggggcagcgcctgctgaattctggctgaccagggcagtcaccagagctccagacaatgtctgtctccttcctcatcttcctgcccgtgctgggcctcccatggggtgtcttgtcacaggtacaactacagcagtcaggtccaggactggtgaagccctcgcagaccctctcactcacctgtgccatctccggggacagtgtctctagcaacaatgctgcttggaattggatcaggcagtccccatcgaggggccttgagtggctggggaggacatactacaggtccacgtggaaaaacgattatgcagcatctgtgaaaagtcgaataaccatcgacccagacacatccaagaaccagttctccctgcaactgaactctctgactcccgaagacacggctgtctattactgtgctatagtgggttcgggtagttactcctagttcgggaccg

SEQ ID NO: 533977 - DNA, 539 bp, Homo sapiens
  misc_feature: HEFZJCU01EDQCH.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttcagtagtttattggatgacttggggtccgccagacctccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtagaaaagtaatggctgtgtttagttggggccgagggagcctggtcaccg

SEQ ID NO: 533978 - DNA, 508 bp, Homo sapiens
  misc_feature: HEFZJCU01DXOHO.3.17.B06.1.454.heavy.3.raw
  modified_base (449)..(449): a, c, t, g, unknown or other
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccaggggaaggggctggagtgggttggccgttctagagacacaactaacagtgacaccgcacaatacgccgcgtctgtgaaaggcagattcaccatctcaagagatgattcagagaactcactttatctgcaaatgaacngcctgagaaccgacgacacggccgtctattattgtgtcatagacctaggatacaacgac

SEQ ID NO: 533979 - DNA, 532 bp, Homo sapiens
  misc_feature: HEFZJCU01EUUTX.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggaacacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgacaaatagacagcctgagaccagacgacacggctgtctattattgcgcgagagagacacacgaacctaactggccaatactatggggcttgttctggggccaggggacctggtcatcgtctccccagccctcaccaagggcccatcggtccttccccctggccgccctcg

SEQ ID NO: 533980 - DNA, 532 bp, Homo sapiens
  misc_feature: HEFZJCU01CQBOA.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctggggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgttattactgtgcgcggtggctgaccgcgtcttgactacgtggggccggggacggcccggtcactcgtcttcc

SEQ ID NO: 533981 - DNA, 502 bp, Homo sapiens
  misc_feature: HEFZJCU01C9IKV.11.71.G05.1.454.heavy.3.raw
  modified_base (446)..(446): a, c, t, g, unknown or other
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagntgaggacacgctgtgtattactgttgcgaaagtatttctagtagaggtcgacgtac

SEQ ID NO: 533982 - DNA, 515 bp, Homo sapiens
  misc_feature: HEFZJCU01BPH33.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcggtcctttgactacgtggggcctgggaactctggtcaccgtct

SEQ ID NO: 533983 - DNA, 522 bp, Homo sapiens
  misc_feature: HEFZJCU01D1RW1.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatgggttcggggagttattagtccctactttgactacgtggggccagggaactctggtcaccgtctccgcacgcctccaccaacgggccccatcc

SEQ ID NO: 533984 - DNA, 514 bp, Homo sapiens
  misc_feature: HEFZJCU01AWGXQ.2.33.C11.1.454.heavy.3.raw
  modified_base (431)..(431): a, c, t, g, unknown or other
acgctcgacacacgaccggtgctcgatttagagtgagctcgttgggtttgggagccccagccttgggattcccaagtgttttcattcagtgatcaggactgaacacagaggactcaccatggactttgggctgaggtggattttccttgctgccattttaaaaggttccactgtgagctgcgactggtggcgtctgggggaggcttggtgcagccgggtgggtccctgcgactctcctgtgcaatttctgaagcccccttcaatacagtgtggatgaattgggtccgccaggctccagggaagggctggagtgggttggccatataaaaagtaagactgctggtgagacaacagactagctgctgccttcagaggcagattcaccaatcttcagagatgaatcacagagcactctgtttctgcaaatgaanagcctggaagacgcggacacagccatgtattattgtactattaaggacattatacgtccctgggggccaaggggaaccctacc

SEQ ID NO: 533985 - DNA, 526 bp, Homo sapiens
  misc_feature: HEFZJCU01AMYUM.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctactgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttctcaaatgaacagcctgagagccgatgacaccggccgtgttattactgtgcgagagatcggggcccacggtaaacgttactacggctagtcggtacgtcgtgggggaccc

SEQ ID NO: 533986 - DNA, 497 bp, Homo sapiens
  misc_feature: HEFZJCU01ECSM0.4.75.G09.1.454.heavy.3.raw
  modified_base (362)..(362): a, c, t, g, unknown or other
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctccgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccnggtggtccttacaatgaccaacatggaccctgtggacacagccacatattactgtgcacagagagtacgggcagcacgttggttttggggctacgtggggaccagggaaccctggtccaccgtctcctcacgcct

SEQ ID NO: 533987 - DNA, 504 bp, Homo sapiens; identical to SEQ ID NO: 445648
  misc_feature: HEFZJCU01BSKGR.17.25.C03.1.454.heavy.3.raw

SEQ ID NO: 533988 - DNA, 517 bp, Homo sapiens
  misc_feature: HEFZJCU01D4A7A.17.33.C11.1.454.heavy.3.raw
  modified_base (496)..(496): a, c, t, g, unknown or other
cgtagactagcacgaccggtgctcgatttagagtgagctcgttgggtttggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtcccttactttgactactggggccagggaactctggtcaccgtctccgcncgcctccaccaaggcccatcc

SEQ ID NO: 533989 - DNA, 546 bp, Homo sapiens
  misc_feature: HEFZJCU01DFUSN.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacactcccctgaaagcgtacaactactactactacggtatggacctctggggccaaggggacccg

SEQ ID NO: 533990 - DNA, 496 bp, Homo sapiens
  misc_feature: HEFZJCU01DNSSB.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagcgtgaggacacggctgtgttattactgtgcgaaagtatttctata

SEQ ID NO: 533991 - DNA, 536 bp, Homo sapiens
  misc_feature: HEFZJCU01CQ79Q.4.35.D02.1.454.heavy.3.raw
agcactgtagcacgaccggtgctcgatttagcacacgatagtttgggtttgggggggaaaatacttttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcggggctattatggttcgggtaggatcccagttggtttttaggataatattggggccgagggggacagcggtcaccgtctcttcagt

SEQ ID NO: 533992 - DNA, 521 bp, Homo sapiens
  misc_feature: HEFZJCU01DQGP7.13.71.G05.1.454.heavy.3.raw
tcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgctatttttagaaggtgtccagtgtgaggtgcagctggtggagtctggggggggcttggtccagcctggggggtccctgagactctcctgtgcagcctctggattcacttttagtaggtattggatgggttgggtccgccagactccagagaagggactggagtgggtggccaacataaaggaagatggaagtgaaagatactatgtggactctgtgaagggccgattcaccatctccagagacaacgccaagaactcactgtatctgcagatgaccagcctgagagtcgaggatacggctgtgtattattgtgcgagagagtgggggcacggactatttttgtagtaggtgtactgggggccaggggaccgg

SEQ ID NO: 533993 - DNA, 496 bp, Homo sapiens
  misc_feature: HEFZJCU01B1SZM.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgagtggaactaatagacgctatgccgactccgtgaagggccgattcaccatctccagagacaattccaagaacacgcagtatctgcaaatgaacagcctgagagctgaggacacggctgtgtattactgtgggacgagagtgggaggtcatattgta

SEQ ID NO: 533994 - DNA, 524 bp, Homo sapiens
  misc_feature: HEFZJCU01DWFST.10.35.D02.1.454.heavy.3.raw
catagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttggttaagccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcaagcctggaaagcgatgaacgacaggactctattattgtaccactaagagtccaacgaagactgtgggaagggactgctc

SEQ ID NO: 533995 - DNA, 527 bp, Homo sapiens
  misc_feature: HEFZJCU01AEPBY.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcatcaccgacactgggaaccccacctatgcccaggccttcacagggcggtttgtcttctccatggatacctctgtcgggacggcttatctgcagataaccaaccttacaacctgacgacactgccgtttattttgtacgagagcgtcgtctgtcagtgaattgactactggggccagggaccctggtcaccgtctcctcagcctccaccac

SEQ ID NO: 533996 - DNA, 511 bp, Homo sapiens
  misc_feature: HEFZJCU01CAA22.13.76.G10.1.454.heavy.3.raw
  modified_base (355)..(355): a, c, t, g, unknown or other
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtgggtagtacatactccgnagactccgtgaggggccgattcaccatctccagagacaattccaagaacacgctgtttcttcaaatgaacagcctgagagccgatgacacgggccgtgtattactgtgcgagagagtggggcccacgaacgttactacgctatggtacgtctgggg

SEQ ID NO: 533997 - DNA, 508 bp, Homo sapiens
  misc_feature: HEFZJCU01ERE48.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcaggtccggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccgatatatttctgtgcgcgaggaatttcgacttcgtggaataattacttgggttggaaacgtacctta

SEQ ID NO: 533998 - DNA, 524 bp, Homo sapiens
  misc_feature: HEFZJCU01DR2HD.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcaggagtcaccctgaccacagagacatccacgaccacagtctacatggagctgtggagcctgagacctgacgacacggccctctatacttgtgacggacggcccttactcctacaggttcgaccaccttcccacgcctgggttccgtacctccgtacgggggg

SEQ ID NO: 533999 - DNA, 520 bp, Homo sapiens
  misc_feature: HEFZJCU01BW9NC.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttccccctggcaccctcctccaagagcacctctgggggcacgagcggccctgggctgcctggtcaaggctacttcctagagacacg

SEQ ID NO: 534000 - DNA, 488 bp, Homo sapiens
  misc_feature: HEFZJCU01C6E0J.53.56.F01.1.454.heavy.3.raw
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctgggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcagggtcgaccatgaccagggacacgtccatcagcacagcctacatggagctacacggcctgagatctgacgacacgccctgtatttttgtgcgagagagtctattaaagtggtcgtt

SEQ ID NO: 534001 - DNA, 504 bp, Homo sapiens; identical to SEQ ID NO: 502995
  misc_feature: HEFZJCU01BLV9K.15.55.E11.1.454.heavy.3.raw

SEQ ID NO: 534002 - DNA, 494 bp, Homo sapiens; identical to SEQ ID NO: 529845
  misc_feature: HEFZJCU01DU0J1.14.25.C03.1.454.heavy.3.raw

SEQ ID NO: 534003 - DNA, 545 bp, Homo sapiens
  misc_feature: HEFZJCU01DA71G.13.57.F02.1.454.heavy.3.raw
tcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttgggtccgccagcccccagggaaggggctggagtggattggggaaatctttcatagcggggatcaccaactacaacccgtccctcaagagtcgagtcaccatatctatagacaagtccaagaaccacttctccctgaacgtgagttctgtgaccgccgcggacacggccgtgtattactgtgcgagaggattgtggtttactcgtggttcaatgtagttattattgtctttgactattggggccagggaaccctggtcaccgtctcctcagcctccaccaaggg

SEQ ID NO: 534004 - DNA, 512 bp, Homo sapiens
  misc_feature: HEFZJCU01CYZYB.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgctagactccgtgaagggccggttcaccatctccagagacaattccaagaacacactgtatctgcaaatgaacagcctgagagccgacgacacggccatatattactgtgcgaaagcaccggcagttagtcacccatactactttgactactgggcctac

SEQ ID NO: 534005 - DNA, 383 bp, Homo sapiens
  misc_feature: HEFZJCU01D61Z6.11.61.F06.1.454.heavy.3.raw
cgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggcgccctgctccaggagcacctccgagagcacagcggccctgggctgcctggtcaaggactactccgtatctctcg

SEQ ID NO: 534006 - DNA, 490 bp, Homo sapiens; identical to SEQ ID NO: 470789
  misc_feature: HEFZJCU01AWI1H.3.34.D01.1.454.heavy.3.raw

SEQ ID NO: 534007 - DNA, 539 bp, Homo sapiens
  misc_feature: HEFZJCU01ED6C0.5.64.F09.1.454.heavy.3.raw
atcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttgagtggatgggagggatcgtccctgtctttggagcagcaaactacgcacatgatttccagggggagagtcacgattacggcggacgaatctacggccacagcctatctggagctgaacaacgtgagacctgaagacacggccgtttactactgtcgcgagagatccgcccccccgaaggggccgaacggaggttataggtgggggcgaacggcgttttgggccgtttctactactacgtaa

SEQ ID NO: 534008 - DNA, 529 bp, Homo sapiens
  misc_feature: HEFZJCU01EUZ28.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacgggctgtgtattactgtgggagtccctggctggcacctgtatccgaccgttggagtcagggaactctggtcaccgtctcctcagcctccaccaagggcccatcggtccttcccccgtggccgcccgtgcctccaggagcacctccgagacgcacaggccggccccgtgggccgtcg

SEQ ID NO: 534009 - DNA, 492 bp, Homo sapiens
  misc_feature: HEFZJCU01BR8O0.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtgcggtcatagtcgtccagtggacatcttcagtattacgcagactccctgaggggccgattcaccatctccagagacaacttcccagaaccacggtctatctgcacctgaccagcctgagaactgacgcacgtctctctactctgtgcgagagagttagacgagt

SEQ ID NO: 534010 - DNA, 549 bp, Homo sapiens
  misc_feature: HEFZJCU01CNV8J.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtggagcaccaactacaacccctccctcaagagtcgtgtcaccgtgtcaatagacacgtccaagaaccagttctccctgaggctgagctctgtgaccgcgcggacacggccgtgtattctgtgcgagatctttcgattttggagttcggtaaccccttggcctacgtcggggccaggggaaccctgggtaccgaccgtccgtcctttcacggtcctcccaccgtaacgggccctacg

SEQ ID NO: 534011 - DNA, 511 bp, Homo sapiens
  misc_feature: HEFZJCU01C65NZ.19.17.B06.1.454.heavy.3.raw
  modified_base (452)..(452): a, c, t, g, unknown or other
  modified_base (505)..(505): a, c, t, g, unknown or other
tactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtctgggggaggcctggtcaagcctggggggtccctgcgactctcctgtgtggtctccggattcccattcagtcactatagtatgatgtgggcccgccaggctccggggaagggctggaatggcttgcatcccttggttggagtggaattaatacacgaccacgcaagactcagtgaggggccggttcaccatcctccagagacaacgccaagagtaccaatgtattacaaatgaacngcctgagagccgaggatacggctgtgtattattgtgcgagaatttccgagccncactta

SEQ ID NO: 534012 - DNA, 503 bp, Homo sapiens
  misc_feature: HEFZJCU01BIA98.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatatttctgtgcgcgaggaatttcgacttctggataattacttggttgaacgtaccttac

SEQ ID NO: 534013 - DNA, 515 bp, Homo sapiens
  misc_feature: HEFZJCU01B7XVE.13.71.G05.1.454.heavy.3.raw
  modified_base (490)..(490): a, c, t, g, unknown or other
tcacgtactacacgaccggtgctcgatttagtgtcgtcgcaagagagaggagcccagccctgggattttcaggtgttttcatttggtgatcaggactgaacagagagaactcaccatggagtttgggccgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgtcttcaccatctccagagactaattccaagaacacgactatatctgcagatgaacagcctggagccgaggacacggccgtttatcactgtgcgaagatattgtaatgataggtagctnctactactactttttagacttactc

SEQ ID NO: 534014 - DNA, 538 bp, Homo sapiens
  misc_feature: HEFZJCU01DSBE2.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcaccgtgaaaggcagattcaccatctcaagagatgattcaaaaagcacgctgtatctgacaaatgaacagcctgagaaccgaggacacagccgtgtaattactacgttaccacagtcccctgaaaagcggttaccaaaccttactactaacttacgggttaa

SEQ ID NO: 534015 - DNA, 538 bp, Homo sapiens
  misc_feature: HEFZJCU01A47ZS.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagaccttaccatgaccacgaactcctccataaacacagcctacatggagttgaggagcctgacatctgacgacgacggccgtctattactgtgcgagacgtacccacgatccggtgacgcctacggacacggccggtccgttttacggaccgttttcgtggggggtcccgtagggggaccgg

SEQ ID NO: 534016 - DNA, 517 bp, Homo sapiens
  misc_feature: HEFZJCU01D6VMR.51.21.B10.1.454.heavy.3.raw
cgatcgtatacacgaccggtgctcgatttagtgtcgtcgcaagggggaaggcatcatccaacaaccacatcccttctctacagaagcctctgagaggaaagttcttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctattttatgtactgggtgcgacaggcccctggacaaggccttgagtggatgggaaagatcaaccctagtggtggtaccacaagttacgcccagaaattccagggcagagtctccatgaccagaaatacgtccgcgaggacagtctacatggagttgagcagcctgagaactgacgacacggccatatattactgtgcgagagaccttgctgtccttttgacctttctggggccaggggaaccccgtggtactacccg

SEQ ID NO: 534017 - DNA, 483 bp, Homo sapiens
  misc_feature: HEFZJCU01BOL15.19.13.B02.1.454.heavy.3.raw
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctcagagacaattccaagaacacgctgtatctgcaatgaaacagcctgagagctgaggacacggctgtgtattactgtgcgaggcggt

SEQ ID NO: 534018 - DNA, 472 bp, Homo sapiens
  misc_feature: HEFZJCU01BE5PF.22.56.F01.1.454.heavy.3.raw
acatacgcgtcacgaccggtgctcgatttagcagacgtctgtcggggttctcattcaccactgcttcagtgggtgtgggctggatccgtcagcccccaggaaaggccctggagtggcttgcactcctttatggggatggcggtgaacactacagtccatctctgaagaccagactcaccatcgcccgggacacctccaagaaccaagtggtccttacactgaccagcgtggaccctgtggacacaacaacatattttctgtgcacagagccgccagttagactggggggcctgtcgtggtggttggtgccgcaatgatgcatttcatatttggggccaagggcagtggtcaccgtctcggcagcctccaccaagggcccatcggtcttccccctggcgccctgctccaggagcacctccgagagcacagcggcctgggctgcctgtcaaggactacttccagtacgtatcta

SEQ ID NO: 534019 - DNA, 520 bp, Homo sapiens
  misc_feature: HEFZJCU01BW8KO.48.24.C02.1.454.heavy.3.raw
agtatacatacacgaccggtgctcgatttagtacagatcgttagggaaagggggctttctgagagtcagggatctcatgtgcaagaaaatgaagcacctgtggttcttcctcctgctggtggcggctcccagatgggtcctgtcccagctgcagctgcaggagtcgggcccaggactggtgaagctttcggagaccctgtccctcacctgcactgtctctggtggctccatcagcagtagtagttactactggggttggatccgccagcccccagggaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacgggtgcccgaagaaaacgtgtttaatcccgtgggccagggaacctggtcaccgtctcctcagcctccaccacggccc

SEQ ID NO: 534020 - DNA, 485 bp, Homo sapiens
  misc_feature: HEFZJCU01DX1FZ.49.21.B10.1.454.heavy.3.raw
agtcgagagacacgaccggtgctcgatttagtgtcgtcgcaaggggctgggagacgagcccagcactggaaggcgccggtgtttccattcggtgatcagcactgaacacagaggactcaccatggagtttgggctgagctgggttttcctcgttggtcttttaagaggtgtccagtgttatgtgcagttggtggagtctgggggaggcgtggtccagcctgggaagtcactgagactcgcctgtacaccctctggattcaccttcagcaactatgcaatgcactgggtccgcctggctcccggcaagggtctggactgggtggcaggtatatcagctgatgggaccaaaatatactacgcaaactccgtgaagggccgattcaccatatcaagagacacttccgatgacacaatctatctgcaatgaacagcctgaaagttgacgacacgggttctttttactgtgcgcctgaagcagtgctgcc

SEQ ID NO: 534021 - DNA, 537 bp, Homo sapiens
  misc_feature: HEFZJCU01A23WN.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctaattacagcgggagcaccaactacaacccgtccctcaagagtcgagttaccatttcattaaacacgtctaagaaccagttctccctgaagctgacctttgtgactgccgcggacacggccgtgtagttactgtgcgagacgaccctccgatagcagtggctggtccacgtacggtttgactactcggggccaggggaacgcttggtccaccggttcctccgtcacggcctccg

SEQ ID NO: 534022 - DNA, 516 bp, Homo sapiens
  misc_feature: HEFZJCU01DYYSD.51.5.A05.1.454.heavy.3.raw
  modified_base (445)..(445): a, c, t, g, unknown or other
cgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaagggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcncctgtgtggcccctaagttttcggttaccggtcacacaaaatcagggcaacgtcctacgacggtctggtac

SEQ ID NO: 534023 - DNA, 508 bp, Homo sapiens
  misc_feature: HEFZJCU01CP4XX.12.2.A02.1.454.heavy.3.raw
  modified_base (440)..(440): a, c, t, g, unknown or other
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatgatcagcgcttacaatggtaacacagactatgcacagaagttccaggacagagtcaccatggaccacagacacatccacgagcacagcctacatggagctgaggagcctgagatctgacgacacgggccgtagtnttaacgtgtgcgaggtaggttttagtggtatacttagttgtagtggtaggtaccttgctacgtttttc

SEQ ID NO: 534024 - DNA, 495 bp, Homo sapiens
  misc_feature: HEFZJCU01ANIW1.47.85.H08.1.454.heavy.3.raw
  modified_base (427)..(427): a, c, t, g, unknown or other
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctctttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtaggcggtcatatcgtccagtggacatcttcagtattacgcagactccctgaggggccagttcaccatctccagagacaattcccagaacacggtctanctgcacctgaccagcctgagaactgacgacacgtctctctactactgtgcgagagagttgacgagtct

SEQ ID NO: 534025 - DNA, 379 bp, Homo sapiens; identical to SEQ ID NO: 444450
  misc_feature: HEFZJCU01EKFRZ.47.77.G11.1.454.heavy.3.raw

SEQ ID NO: 534026 - DNA, 538 bp, Homo sapiens
  misc_feature: HEFZJCU01EMHDM.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttcagtagttattggatgacttgggtccgccagactccagggaagggctggagtgggtggccaacataaagcaagatggaactgccgagtttacgtggactctgtgaagggccgtttcaccatctccagagacaacgccaagaattcactgtatctacaactgaacagcctgagagtcgcagacacggccgtgtattactgtgcgagatgagaaaagtaatggctgtgtttagttggggccgtagggacgcccgtggtctaccg

SEQ ID NO: 534027 - DNA, 427 bp, Homo sapiens; identical to SEQ ID NO: 444708
  misc_feature: HEFZJCU01BNYDV.9.34.D01.1.454.heavy.3.raw

SEQ ID NO: 534028 - DNA, 510 bp, Homo sapiens
  misc_feature: HEFZJCU01EM93F.53.61.F06.1.454.heavy.3.raw
cgcgtatacacacgaccggtgctcgatttagctacgctctaagggaaagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctgggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattactgtgcgaaacggtttgtaggtgggaagttaggggtcg

SEQ ID NO: 534029 - DNA, 527 bp, Homo sapiens
  misc_feature: HEFZJCU01B8ZWK.13.37.D04.1.454.heavy.3.raw
  modified_base (454)..(454): a, c, t, g, unknown or other
tcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagtttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagccgtaggggacnccggaggaccacgggtccgttttagtccacttggtaggacgaaaaaggacttatttagtaaatgaagtgggta

SEQ ID NO: 534030 - DNA, 512 bp, Homo sapiens
  misc_feature: HEFZJCU01BPP54.51.12.B01.1.454.heavy.3.raw
cgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccgggacacgtccatcgccacaacttacatggaactgaccagtctgacatttgacgacacggccgtctattactgtgcgacagaagcggcggacagaggttcgcttactggttcgaggctcctcccctacg

SEQ ID NO: 534031 - DNA, 542 bp, Homo sapiens
  misc_feature: HEFZJCU01BPIY2.9.34.D01.1.454.heavy.3.raw
  modified_base (471)..(471): a, c, t, g, unknown or other
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaacctggtcgccgtctctcagcctccaccaagggcccatcggtcttcccctggccaccctcctccaagagcacctcgtagggacncacgcggcccgtccggtcggtctcgtcgtcgtacgaacggtaacttcctacacgtacgttacgactacgta

SEQ ID NO: 534032 - DNA, 481 bp, Homo sapiens
  misc_feature: HEFZJCU01CJYDW.10.35.D02.1.454.heavy.3.raw
  modified_base (446)..(446): a, c, t, g, unknown or other
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacacctgtatctggaaatgagcagcctggaaagcgatgacacagggactctattattgtaccactaagagtcccacgaagactgtgggaagggactgctggggccagggagcccttgtcaccgtctcctcagcctccaccaagggcccatcggtcttcccctgcgccctgctccaggagcacctccgagagcacagcggcccngggctgcctggtcaaggactacttccactactatg

SEQ ID NO: 534033 - DNA, 500 bp, Homo sapiens
  misc_feature: HEFZJCU01D1AEK.17.10.A10.1.454.heavy.3.raw
  modified_base (417)..(417): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaagcacagtatgcaccgaagatgaagggcagagtcacgattaccacggacacccccacgaacacagtctacatgcaactgacgagcctgagngactgaacgacacggccgtctattactgtgcgagaatgttttctgtcatcgtacaatttgataggctctatggactggacttc

SEQ ID NO: 534034 - DNA, 395 bp, Homo sapiens; identical to SEQ ID NO: 444517
  misc_feature: HEFZJCU01BRDG1.16.68.G02.1.454.heavy.3.raw

SEQ ID NO: 534035 - DNA, 517 bp, Homo sapiens
  misc_feature: HEFZJCU01CG892.11.13.B02.1.454.heavy.3.raw
cgagagataccacgaccggtgctcgatttagtctagcgactttgggttctccttgttgctattttagaagttgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacgggctgtgtattactgtgggagtccctggctggcacctgtatccgaccgttggagtcagggaactctggtcaccgtctcctcagcctccaccaagggccatcggtcttcccctggccgcctgctccaggagcacctccgagagcacagtcggccctgggctcg

SEQ ID NO: 534036 - DNA, 429 bp, Homo sapiens; identical to SEQ ID NO: 515887
  misc_feature: HEFZJCU01DV271.40.34.D01.1.454.heavy.3.raw

SEQ ID NO: 534037 - DNA, 499 bp, Homo sapiens
  misc_feature: HEFZJCU01EPVHO.3.71.G05.1.454.heavy.3.raw
agacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaaggcctggagtgggtctcaggtattacttggaatagtgataacatcggctatgcggactctgtgaagggccgattcaccatctccagagacaacgccaagaactccctgtatctgcaaatgaacagtctgagacctgagacgacggccttgtattactgtgtaagtcccgggaaatagtgtacgta

SEQ ID NO: 534038 - DNA, 499 bp, Homo sapiens
  misc_feature: HEFZJCU01DJ2ZZ.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattccaccgtctccagagacaattccaggcacacgctgtatctgcaaatgaacagcctgagagctgaggacacggctgtgtattactgtgcgaaagatttctatagaggtgacgtacgggggcttcg

SEQ ID NO: 534039 - DNA, 502 bp, Homo sapiens
  misc_feature: HEFZJCU01BFVNL.51.3.A03.1.454.heavy.3.raw
cgatcgtatacacgaccggtgctcgatttagagagcgtcacaggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaagctttgagtggatgggatggatcaccgctggcaatggtgacacaaaatattcacagaagttccagggcagagtcaccattaacagggacacatctgcgagtacaggctacatggaactgagcggctgagatctgaggacacggctatttattactgtgcgagagggaaagtgggatattgtggcaggctccaggtgcccaggcccggcccccttaacg

SEQ ID NO: 534040 - DNA, 497 bp, Homo sapiens
  misc_feature: HEFZJCU01C2RZK.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagacctacatcggagctgaacagactgacatctgacgacacggccgtttattattgtgtgtagagaggacccgatcgaccgtc

SEQ ID NO: 534041 - DNA, 542 bp, Homo sapiens
  misc_feature: HEFZJCU01DN0F4.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaactgatggtgggacaacagactacgctgcacccgtgaaaggcagattcaccatctcaagagatgattcaaaagcacgctgtatctgcaatgaacagcctgagaaccgaggacaacgagccgtgtattactgtaccacatccctagaaacgcgtcaactacctactactacggtatcggacctcgtcggggaccg

SEQ ID NO: 534042 - DNA, 504 bp, Homo sapiens
  misc_feature: HEFZJCU01B5W0N.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactcgtgagggccgattcaccatctccagagacaatccagaacacaatgtattaggaatgaacagacctaagtcctgagacgacggtgtatactatgtacgaaggagggggaccgagcgggagttaccaagt

SEQ ID NO: 534043 - DNA, 432 bp, Homo sapiens
  misc_feature: HEFZJCU01CHG60.4.37.D04.1.454.heavy.3.raw
  modified_base (426)..(426): a, c, t, g, unknown or other
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgccactgggtgcgactggcccctggacaagggcttgagtggatgggatggatcgaccctaacagcggtggcacaaagtattgcacagaagtttcagggcagggtcaccgatgaccagggacagtccatcagcacgtccatcagcacagcctanactgga

SEQ ID NO: 534044 - DNA, 503 bp, Homo sapiens
  misc_feature: HEFZJCU01CDHJM.14.55.E11.1.454.heavy.3.raw
cgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaagggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatgggagggggtggtgatccga

SEQ ID NO: 534045 - DNA, 485 bp, Homo sapiens
  misc_feature: HEFZJCU01CA27Y.12.75.G09.1.454.heavy.3.raw
atacgacgtacacgaccggtgctcgatttagtatagacatcagggggcatcacataacaaccacattcctcctctaaagaagcccctgggagcacagctcatcaccatggactggaccctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcagggccctcccacatcggttta

SEQ ID NO: 534046 - DNA, 492 bp, Homo sapiens
  misc_feature: HEFZJCU01EIG0U.48.23.C01.1.454.heavy.3.raw
  modified_base (453)..(453): a, c, t, g, unknown or other
agtatacatacacgaccggtgctcgatttagtacacgtgattagggattggggacccaacaaccacatccctcctcagaagcccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggcccccggacaaagccttgagtggatggggtggctcaacgctggcgatggtcagacaaagtattcacagaagttccgagggcagagtcaccatcaccagggacacggtccgcgagtagtgtcttcatggagctgcgcagtctgagatcggaagacacggcagtatattactgtgngagaggcggatattgtcggtcgagggtgactgctacagt

SEQ ID NO: 534047 - DNA, 491 bp, Homo sapiens
  misc_feature: HEFZJCU01CSACY.40.22.B11.1.454.heavy.3.raw
tctagcgactcacgaccggtgctcgatttagacgacagctcaggggtctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgtattcaccatctccagagacaatgccaagaactcactgtatctgcaaatgaacagcctgagagacgaggacacggctgtatattactgtgcgagagagccaggtcggctact

SEQ ID NO: 534048 - DNA, 516 bp, Homo sapiens
  misc_feature: HEFZJCU01EZYJW.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagactcactatatttgcaaatggaccgcctgagagacgaggacacggctatgtattactgtgcgagagatgagagtggctacagttgggggccggggaaccctgggtcaccgtctaa

SEQ ID NO: 534049 - DNA, 519 bp, Homo sapiens
  misc_feature: HEFZJCU01BLBF2.19.86.H09.1.454.heavy.3.raw
tactctcgtgcacgaccggtgctcgatttagtgctatagacttgggtttggggggaagaggaagactgacggtcctgccacaggtggtgctgggcacggtgggcactcgacacaacatttgcgctcaactgtcttgtccaccttggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatcacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcagggacggggctaaagggcataaagtggttcgacccctggggccagggaaccctgggtcaccgtctcctcagccctccacccg

SEQ ID NO: 534050 - DNA, 512 bp, Homo sapiens
  misc_feature: HEFZJCU01BMODK.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtcccgcgggacttctggggccgagggaaccct

SEQ ID NO: 534051 - DNA, 536 bp, Homo sapiens
  misc_feature: HEFZJCU01CLXUP.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtgggtccaggcctgggaggtcacagagactctcgtgtgcagcctctgggttcaccttcagtaactacggcatgcactgggtccgccaagctccaggcaaggggattggagtgggtggcagttgtttcatctgagggcagtgttcaatggtatgcagactccggtgaagggccgattcaccatctccagagacaattccaggaacacaatgtatttggagctgaacagcctaagtcctgaggacacgggcgtataccttactagttacgaaggggacggggggaaccgtaacggcggggacgttaccgaagtactccttttggtacc

SEQ ID NO: 534052 - DNA, 524 bp, Homo sapiens
  misc_feature: HEFZJCU01CIGV0.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgaggcagagtacaccctgaccacagacacatccgcgaacacagcctacatggaactgaggaatctgacatctgacgacacggccatatattactgtgcgagaaggacggttttggggcgcggactcctcttgagatctggggccgaggggacaagtggtcaccggtctcttcagt

SEQ ID NO: 534053 - DNA, 525 bp, Homo sapiens
  misc_feature: HEFZJCU01B887J.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacctaacactggtgtcacagtgtcttcacccatcctccgggacagacttaccatgaccacgaactcctccataaacacagcctacatggagtttgagggagcctgacatctgacgacacggccgtctattactgtgcgagacgtcccgaccgagtcccggtggacgtccctacgggcacggcgggtccctttggtacctttcgtcc

SEQ ID NO: 534054 - DNA, 504 bp, Homo sapiens
  misc_feature: HEFZJCU01A54WO.17.10.A10.1.454.heavy.3.raw
  modified_base (451)..(451): a, c, t, g, unknown or other
  modified_base (461)..(461): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccgacggacacccccacgaacacagtctacatgcaactgacgagcctgagagctgacgacacggccgtctattactgtgcganaatgttttcngtcatcgtacaatttgataggctctatggactggacttcgtac

SEQ ID NO: 534055 - DNA, 514 bp, Homo sapiens
  misc_feature: HEFZJCU01DGP0C.17.34.D01.1.454.heavy.3.raw
  modified_base (459)..(459): a, c, t, g, unknown or other
cgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgngaggagtaattactataacactgcttcctttttactacctccctttgactttcgt

SEQ ID NO: 534056 - DNA, 495 bp, Homo sapiens
  misc_feature: HEFZJCU01E18FY.53.81.H04.1.454.heavy.3.raw
cgcgtatacacacgaccggtgctcgatttagtagtgtagattcgcgggggctctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtgggtggcagttatatcatttgatggaagcactacatactacgcaaactccgtgaagggccgattcaccatctccagagacgattccaggaacactctgtttctccaaatgaacagcctgagagctgaggacacgggctcttttacttaacttgtgcgagagagttctgggat

SEQ ID NO: 534057 - DNA, 517 bp, Homo sapiens
  misc_feature: HEFZJCU01A5S6O.51.21.B10.1.454.heavy.3.raw
cgatcgtatacacgaccggtgctcgatttagtgtcgtcgcaagggggagggcatcatccaacaaccacatcccttctctacagaagcctctgagaggaaagttcttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctattttatgtactgggtgcgacaggccctggacaaggccttgagtggatgggaagatcaaccctagtggtggtaccacaagttacgcccagaaattccagggcagagtctccatgaccagaaatacgtccgcgagggacagtctacatgggagttgagcagcctgagaactgacgaccacggccatatattactgtgcgagagaccttgctggtccttttgacttcgtggggccacggggaaccctggtcctacccg

SEQ ID NO: 534058 - DNA, 526 bp, Homo sapiens
  misc_feature: HEFZJCU01EJORU.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactagtgggggcttgttctgggggccgaggggaccctggtcatcgtctccccagcctccaccaagggcccatcggtccttcccctggccg

SEQ ID NO: 534059 - DNA, 512 bp, Homo sapiens
  misc_feature: HEFZJCU01DBKGJ.52.78.H01.1.454.heavy.3.raw
cgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctgggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgaagcagcctgacatccggagacacggccgtgtattactgtgcgagagttctttgggatgttgtcgtttgcacc

SEQ ID NO: 534060 - DNA, 529 bp, Homo sapiens
  misc_feature: HEFZJCU01B975F.16.27.C05.1.454.heavy.3.raw
  modified_base (424)..(424): a, c, t, g, unknown or other
  modified_base (487)..(487): a, c, t, g, unknown or other
  modified_base (519)..(519): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttcnccaagtgattgatctgagaagtgaggacacggctgtttattactgtgcgcggtggctgaccgntcttgactacgtggggccggggagccccggtnatcgtctccg

SEQ ID NO: 534061 - DNA, 405 bp, Homo sapiens; identical to SEQ ID NO: 445302
  misc_feature: HEFZJCU01DHS27.3.17.B06.1.454.heavy.3.raw

SEQ ID NO: 534062 - DNA, 532 bp, Homo sapiens
  misc_feature: HEFZJCU01C1E1Y.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggcctccagggaagggctggagtgcgtctcttttatttatagtagtggtagtacatacctccgcagactccgtggaggggccgattcaccatcctccagagactaattccaagaacacgctgtttcttcaaatgaacagcctgagagccgatgacacggccgtgtaattactgtgcgagagatggggcccacgaacgttactacgtctagtggtacgtcgtcggggccaaggggacccg

SEQ ID NO: 534063 - DNA, 300 bp, Homo sapiens
  misc_feature: HEFZJCU01EQI7T.49.35.D02.1.454.heavy.3.raw
agtcgagagacacgaccggtgctcgatttagcacacgatagttgggtttgggtagttgggtttgggggaagaggaagactgacggtcctcccaggagttcaggtgctgggcaccgtgggcatgggggaggcgtggtccagcctgggaggtccctgtagactctcctgtgcagcctctggattcgtctctagtgtctacctatgcactggtccgccaggctccaggcaaggggctggaatgggtggcacttatctcatctggatggaaggtctgaatctatgccgactccgtgaacgggcc

SEQ ID NO: 534064 - DNA, 425 bp, Homo sapiens
  misc_feature: HEFZJCU01A4YL2.49.87.H10.1.454.heavy.3.raw
agtcgagagacacgaccggtgctcgatttagcagtactgcgttgggtttggggatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttccgaacaactttgctgtcagtctgggtgcgacacggcccctggacaaggtccttgagtggggtagggaagggactcacccctatccttaatatagcaaactatgcacagaccattccgaacgacgagagtcacccttatcgcggaacaaactccaacgaacacagcctaca

SEQ ID NO: 534065 - DNA, 536 bp, Homo sapiens
  misc_feature: HEFZJCU01EL0DE.48.14.B03.1.454.heavy.3.raw
agtatacatacacgaccggtgctcgatttagtgtgagtagttccgcggggctcagagaggagccttagccctggactccaaggcctttccacttggtgatcagcactgagcacagaggactcaccatggaattggggctgatctgggttttccttgttgctctttttggaggtgtccactgtgaggtgcaactggtggaatctgggggaggcttggtccagcctgggggctctctcagactctcctgtgaaacctctggattcacctttacgactttttggatgggttgggtccgccaggccccagggaaggggctgcagtgggtggccaacacaaatcaaaatggaaacgtggagtactatgcggagtctgtgaagggccggttcaccatctacagagacaacggcaagaagtcgctgttctgcaaatgaacagcctgacctccgacgacacggctctctattattgtgtgagagaatctggggaccggccgtcgttcgggggccaggggaacacgtggttatcgtctcttcacg

SEQ ID NO: 534066 - DNA, 493 bp, Homo sapiens; identical to SEQ ID NO: 517087
  misc_feature: HEFZJCU01BYR4L.53.26.C04.1.454.heavy.3.raw

SEQ ID NO: 534067 - DNA, 540 bp, Homo sapiens
  misc_feature: HEFZJCU01E1C11.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcattttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggccgtttcatgtctggggccaagggacgctggtcaccgtctcttcagcctccaccaagggcccatcggtcttcccctggcaccctcctccaagagcacctcgtgggggcacagcc

SEQ ID NO: 534068 - DNA, 523 bp, Homo sapiens
  misc_feature: HEFZJCU01C0TON.3.55.E11.1.454.heavy.3.raw
agacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccaaggggaaccccggtcgaccgtctcctcagcctccaccgaaggcccatcggtccttccccgtggccaccctcctccaa

SEQ ID NO: 534069 - DNA, 493 bp, Homo sapiens
  misc_feature: HEFZJCU01DUPVY.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgacaaatgaacagcctgagagctgaggacacggctgtgtattactgtgggagagatggaggtcatattgta

SEQ ID NO: 534070 - DNA, 488 bp, Homo sapiens
  misc_feature: HEFZJCU01EFKK7.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttagctattttagaaggtgtccagtgtgaggtgcaattggtgcaatctggggaggcttggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgacccagcctgagaactgacgacacgtctctcactactgtgcgagagagttgacg

SEQ ID NO: 534071 - DNA, 497 bp, Homo sapiens
  misc_feature: HEFZJCU01DPHKQ.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattacgtgtaggaagagtacgttggtggcgtaccgcggggctgacacgt

SEQ ID NO: 534072 - DNA, 542 bp, Homo sapiens
  misc_feature: HEFZJCU01EZNR4.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtatggctgtgttttagttgggggccaggggagcccgtggtcctaccg

SEQ ID NO: 534073 - DNA, 485 bp, Homo sapiens
  misc_feature: HEFZJCU01EOKDO.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacgacgggtgtatattactgtggtagaggcccccagtagacatgcacctccgtctctggtgct

SEQ ID NO: 534074 - DNA, 487 bp, Homo sapiens
  misc_feature: HEFZJCU01EGS0D.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactggtccgccagactccaggcagggggctggagtgggtggcgagttatttcatatgatggaaatagtgacttctattcagactccgtgaagggccgattcaccgtctccagagacaattccaaggcacacgctgtatctgcaaatgaacagcctgagagctgaggacacgggctgtgtatttactgtgcgaaag

SEQ ID NO: 534075 - DNA, 524 bp, Homo sapiens
  misc_feature: HEFZJCU01CHBF5.12.40.D07.1.454.heavy.3.raw
atacgacgtacacgaccggtgctcgatttagtgatagagcgtaacacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgcacggctgtctattattgcgcgagagagacacacgaacctactggccaagtactatgggggctgttctggggccagggaccctggtcatcgtctccccagcctccaccagggcccatcggtcttccccctggcgccctcg

SEQ ID NO: 534076 - DNA, 501 bp, Homo sapiens
  misc_feature: HEFZJCU01BPSII.53.53.E09.1.454.heavy.3.raw
cgcgtatacacacgaccggtgctcgatttagagagagtgtgttgggtttgggggagcatcaccctgcaaccacagctgtcctctagagaacccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgacatctgacgacacggccgttttattacttgttgtgagaggaggaccccggatcgaccttcc

SEQ ID NO: 534077 - DNA, 539 bp, Homo sapiens
  misc_feature: HEFZJCU01E0WM7.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgttacgagagcgtcgtctgtcagtggaattgactactggggccacgggaaccctggtcaccgtctcctcagcctccaccgaacggcccg

SEQ ID NO: 534078 - DNA, 506 bp, Homo sapiens
  misc_feature: HEFZJCU01EE09U.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacgggacacccccacgaacacagtctacatgcaactgacgagcctgagagctgacgacacggccgtctattactgtgcgagaatgttttactgtcatcgtacaatttgataggctctatggactgggactttcgtc

SEQ ID NO: 534079 - DNA, 523 bp, Homo sapiens
  misc_feature: HEFZJCU01B5M7H.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctgggagtgggttggccgttctagagacacgaactaacagtgacaccgcacaatacgccgcgtctgtgaaaggcagattcaccatctcaagagatgattcagagaactcactttatctgcaaatgaacagcctgagaaccgacgacacggccgtctattattgtagtcatagacctaggataacaacgacggtaggtacctggtattc

SEQ ID NO: 534080 - DNA, 535 bp, Homo sapiens
  misc_feature: HEFZJCU01DZPHK.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcacttaaacacgtctaagaaccagttctccctgaagctgacctttgtgactgccgcggacacggccgtgtattactgtgcgagacgaccctccgatagcagtggctggtccactaggtttagacttacgtggggacccaggggaagtcttcggtcaccgtcctcctcgagcctcccg

SEQ ID NO: 534081 - DNA, 510 bp, Homo sapiens
  misc_feature: HEFZJCU01AZS6Q.10.34.D01.1.454.heavy.3.raw
catagtagtgcacgaccggtgctcgatttagatcgtctgtgttgggtttggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaaggggctgggagtgggttggccatattaaaatcaaagctgatggtgggacaacagagcacgctgcacccgtgaaaggcagattcagcatctcaagagatgattcaaaaagtacgactgtatctgaacatgaaacagcctaggaaaacggaggaacacagccgtgtattactgtgccactcaaggaccgaatattgtt

SEQ ID NO: 534082 - DNA, 538 bp, Homo sapiens
  misc_feature: HEFZJCU01DG2DD.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccggggggaggcttagttcagcctgggaagtccctgagactctcctgtgcagcctctggattcaccttcagcaattactggctgcactgggtccgccaagctccagggaagggctggtgtgggtctcacatattaatctcgatgggataatttagcctacgcggactccgtcaagggccgattcaccgtctccagagacaacaccaagaacacactatatctgcagattgacagtctgagacccgaggacacggcgtgtgtattactgtgcgaaggcagttcgtaggaaactagttatgggttggggggtagtttggggtttttttacgttacgttacgggt

SEQ ID NO: 534083 - DNA, 488 bp, Homo sapiens
  misc_feature: HEFZJCU01EHOQQ.10.55.E11.1.454.heavy.3.raw
catagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcgagggcagagtctccatgaccagtgacacgtccgcgagcactgtctatatggagatgaggagcctgagacttgacgacacggccgtatattactgtgcgagaatcgaagaggtgctacaatcac

SEQ ID NO: 534084 - DNA, 395 bp, Homo sapiens
  misc_feature: HEFZJCU01B1S6K.10.42.D09.1.454.heavy.3.raw
catagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtcttccccctggcgccctgctccaggagcacctccgagagcacagcggccctgggctgcctgtcaaggactacttcccactactatg

SEQ ID NO: 534085 - DNA, 495 bp, Homo sapiens
  misc_feature: HEFZJCU01AFPAO.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaagggctggaatgggtctcatctattagtgctactactggtggcacatacttcgcagactccgtgaagggccggttctccatctccagagacaattccaagaacacggctgtatctgcaattgaacagcctgagagccgaggacacggccgtatattaactgtgcgaaagatttggggaatggaccactac

SEQ ID NO: 534086 - DNA, 509 bp, Homo sapiens
  misc_feature: HEFZJCU01A54OE.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctgggagtgggtctcagtttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccaggggacg

SEQ ID NO: 534087 - DNA, 541 bp, Homo sapiens
  misc_feature: HEFZJCU01A3Y5J.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccttcagtagttattggatgacttgggtccgccagactccagggaaggggctggagtgggtgccaacataaagcaagatggaactgcgagttttacgtggactctgtgaagggccgtttcaccatctcagagacaacgccaagaattcactgtatctacaactgaacagcctgacgagtcgcagacacggccgtgtattactgtagcgagattgtggaaaagtaatggacttgttagtttagttgggggtccgaggggacggtcccgtggt

SEQ ID NO: 534088 - DNA, 520 bp, Homo sapiens
  misc_feature: HEFZJCU01B6ZEM.40.81.H04.1.454.heavy.3.raw
tctagcgactcacgaccggtgctcgatttagtagtgtagattcgcgggggcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggaccgcgtccatcagcacagtctacatggatctgagcggactgacctactgacgacacggccatgtattactgtgggaagaggacgttggtggtccgtaaccggtcggggcgttaggaccctacgtcgggggcctaac

SEQ ID NO: 534089 - DNA, 546 bp, Homo sapiens
  misc_feature: HEFZJCU01CV45P.17.28.C06.1.454.heavy.3.raw
  modified_base (371)..(371): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgnggactctgtgaagggccgtttcaccatctccagagacaacgccaagaattcactgtatctacaactgaacagcctgagagtcgcagacacggccgtgtattactgtgcgagatgtaggaaaaagtaatggactggtgttttagttgggggccagggggacgccctggtcctaccc

SEQ ID NO: 534090 - DNA, 488 bp, Homo sapiens
  misc_feature: HEFZJCU01C1YNX.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgtgtcggggggaggcgtggcccagcctgggaggtccctcagacctctcctgtgcagcgtctggattcagtttcgctacacatggcatgcactgggtccgccagtctccaggcaaggggctgcagtggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtgtcccttgattacta

SEQ ID NO: 534091 - DNA, 526 bp, Homo sapiens
  misc_feature: HEFZJCU01D0164.13.65.F10.1.454.heavy.3.raw
tcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggtacggttttggggcgcggactcctcttgagatcgtggggccgaggggacaagtggtcaccgtctcttcacgt

SEQ ID NO: 534092 - DNA, 409 bp, Homo sapiens; identical to SEQ ID NO: 444519
  misc_feature: HEFZJCU01BD89P.3.41.D08.1.454.heavy.3.raw

SEQ ID NO: 534093 - DNA, 506 bp, Homo sapiens
  misc_feature: HEFZJCU01CFJTR.51.40.D07.1.454.heavy.3.raw
  modified_base (365)..(365): a, c, t, g, unknown or other
cgatcgtatacacgaccggtgctcgatttagtgatagagcgtaacaacagagggggctctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggaggcgtggtccagcctgggaggtccctgagactctcctgtgtagtctctggattcaccttcagggtgtacgacatgcactgggtccgccaggctccaggcaaggggctggagtgggtggcatttatatcacatgatgggaagtaaaacntaactatgcagagtccgtgaagggcgatcaccatctccagagacaattccaagaacacactgtttctgcacatgaaaagcctgagagctgaggacacggctgtttattactgtgcgaacttaatcacggaggactaaaccc

SEQ ID NO: 534094 - DNA, 501 bp, Homo sapiens
  misc_feature: HEFZJCU01EFIQG.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatggggtggcagatatacaatatgatgacagtaaaatatactatggagactccttcaagggccgaattcaccatctccagagacaattccaagaacatggtgtatctgcaaatgaccagcctgagagccgaggacacgggtgtttattactgtgggagaaatcctagtggctacg

SEQ ID NO: 534095 - DNA, 500 bp, Homo sapiens
  misc_feature: HEFZJCU01AX5TZ.13.71.G05.1.454.heavy.3.raw
  modified_base (461)..(461): a, c, t, g, unknown or other
tcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggaggcgtggtccagcctggggaatccctgacactgtcttgtgtagcctctggattcagcttcagaacctatggcatgcactgggtccgccaggccccaggcaaggggctggagtggctgactcttttatcatatgatggagtcaaaaattctatgcagactccgtgaagggccgaattcaccgtctccagggcaactccaagaacaccttatatctgcagatgaacagcctgagaggtgacgactcggctgtatacttctagtntcgacgaaacatgattgtttaggaggtggatgtggttta

SEQ ID NO: 534096 - DNA, 495 bp, Homo sapiens
  misc_feature: HEFZJCU01BGTFE.16.12.B01.1.454.heavy.3.raw
tgtactactccacgaccggtgctcgatttagtagtgtagatttgggcttggaacagcctggggggtccctgagactctcctgtgcaacctctggattcacctttaccagctatgccatgagctgggtccgccaggctccagggaaggggctggagtgggtcgcagccattagtggtattcgtgatgccacatactacgcagactccgtgagggggccgttcaccatctccaggcgacacttccaggagcacgttgtatctgcaaatgaacagcctgagagtcgaggacacggccctatattactgtgcgaaagatgtaaagtgggcgctactggactcgggggcttttgatatctggggccaagggacaatggtcaccgtctcttcagcctccaccaagggcccatcggtcttcccctggcaccctcctccagagcacctctgggggcacagcggccctgggctgcctggtcaaggactacttccgagtagtaca

SEQ ID NO: 534097 - DNA, 521 bp, Homo sapiens
  misc_feature: HEFZJCU01ETQTP.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttcttggggccaggggaccctggtcatcgtctccccagcctccaccaggcccatcggtcttcccctggccg

SEQ ID NO: 534098 - DNA, 484 bp, Homo sapiens
  misc_feature: HEFZJCU01BQ4D9.5.34.D01.1.454.heavy.3.raw
atcagacacgcacgaccggtgctcgatttagatcgtctgtgttgggtttgggggctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctagtgtattactagtgacgag

SEQ ID NO: 534099 - DNA, 527 bp, Homo sapiens
  misc_feature: HEFZJCU01DJPV6.17.34.D01.1.454.heavy.3.raw
  modified_base (490)..(490): a, c, t, g, unknown or other
cgtagactagcacgaccggtgctcgatttagatcgtctgtgttgggtttggggacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctcgtcatctgaggacacgggcttctactctgtgcgaggaagtattactataacactgctccttttacncctcccttgacttctgggcatggaacccggtcaccgt

SEQ ID NO: 534100 - DNA, 540 bp, Homo sapiens
  misc_feature: HEFZJCU01EEL7T.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccacgtcctccaccaacggggccacgtactccgttcccttccccgtcggccgtcccg

SEQ ID NO: 534101 - DNA, 482 bp, Homo sapiens
  misc_feature: HEFZJCU01B4FXE.7.10.A10.1.454.heavy.3.raw
  modified_base (445)..(445): a, c, t, g, unknown or other
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttcccctggcaccctcctccaagagcacctctgggggcacagcggcccngggctgcctggtcaaggactacttcctagagacaccg

SEQ ID NO: 534102 - DNA, 502 bp, Homo sapiens
  misc_feature: HEFZJCU01CEH3C.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcaggttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttactatagaaggtgacgtac

SEQ ID NO: 534103 - DNA, 497 bp, Homo sapiens
  misc_feature: HEFZJCU01B4Y2J.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatcgaacagcctgagagctgaggacacggctgtgttattactgtgggagagagtgggaggtcgatattgta

SEQ ID NO: 534104 - DNA, 501 bp, Homo sapiens; identical to SEQ ID NO: 447719
  misc_feature: HEFZJCU01DP3AX.17.10.A10.1.454.heavy.3.raw

SEQ ID NO: 534105 - DNA, 479 bp, Homo sapiens
  misc_feature: HEFZJCU01D8482.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgacctaacagcggtggcacaaagtatgcacagaagtttcagggcagggtcaccatgaccagggacacgtccatcagcacgtccatcagcacagcctacatggacctgagcggcctgacatctgacgtacacggccgtatatttctgtgcgaggg

SEQ ID NO: 534106 - DNA, 481 bp, Homo sapiens; identical to SEQ ID NO: 445006
  misc_feature: HEFZJCU01CI0CZ.7.10.A10.1.454.heavy.3.raw

SEQ ID NO: 534107 - DNA, 529 bp, Homo sapiens
  misc_feature: HEFZJCU01CG8ZZ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatccggtccttcccctggccgcctcg

SEQ ID NO: 534108 - DNA, 504 bp, Homo sapiens
  misc_feature: HEFZJCU01DINF7.13.33.C11.1.454.heavy.3.raw
  modified_base (489)..(489): a, c, t, g, unknown or other
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattcgacaaacgatgtcttttnatatagtcggggacc

SEQ ID NO: 534109 - DNA, 505 bp, Homo sapiens
  misc_feature: HEFZJCU01A4SWD.11.19.B08.1.454.heavy.3.raw
  modified_base (207)..(207): a, c, t, g, unknown or other
cgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaancttggtacagcctggagggtccctgagactcttctgtgcagcctctggattcgactttagtagttatgaaatgaactgggtccgccaggctccagggaaggggctggagtgggtttcatacatttctagtaattctggtaccatacactatgcagtctctgtgaagggccattcaccatctccagagacaacgccaggaactcacttatctgcaaatgagcagcctgagagtcgaggacacgggtatttattactgtgcgagagagtagtactgtctatgcttccggggagtccgtaa

SEQ ID NO: 534110 - DNA, 522 bp, Homo sapiens
  misc_feature: HEFZJCU01ES7R7.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttattatagtagtggtagtacatactccgcagactccgtgaggggccgattcaccatctccagagacaattccaagaacacgctgtttcttcaaatagaacagcctgagagccgatgacacggccgtgtattactgtgcgagagatgggggcccacgaacgttactaccgctatggacgtctggggccgaagggacccg

SEQ ID NO: 534111 - DNA, 534 bp, Homo sapiens
  misc_feature: HEFZJCU01BJ1O9.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccataatccgcagacacgtccgagaatcacttctccctgaaactgagctctgtgaccgccgcagacacggctgtttaattactgttcgagacatcgccgaccgaggagcattatcggcagttacgggttttgattagttttgggggccaaggggacaaggggtcaccgtctccgcagcctaccaaccg

SEQ ID NO: 534112 - DNA, 524 bp, Homo sapiens
  misc_feature: HEFZJCU01EVJSC.12.40.D07.1.454.heavy.3.raw
  modified_base (508)..(508): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatcttgcaaatagacagcctgacgaccagacgacacggctgtctattattgcgcgagagagacacacgaacctactggccaatactatgggggcttgttcttggggccaggggaccgtggtcatcgtctccccagcctccaccaagggcccancggtcttcccctggcg

SEQ ID NO: 534113 - DNA, 515 bp, Homo sapiens
  misc_feature: HEFZJCU01BH1DO.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcgacgtatcaatcctgatggcagtgttataaattatgcggactccgtgaggggccgattcagcatctccagagacaacggcaagagtatactgtatctggaaatgaacaatctgagagtcgacgatacggctgtctatcattgtggttttcgatgccttcgggtcccgcgggtaccttcgtggggccgtaac

SEQ ID NO: 534114 - DNA, 512 bp, Homo sapiens
  misc_feature: HEFZJCU01BGAJB.8.42.D09.1.454.heavy.3.raw
  modified_base (441)..(441): a, c, t, g, unknown or other
ctcgcgtgtccacgaccggtgctcgatttagacacatacgcagggaaagggggggagaggagcccagcactgggattccgaggtgtgtccattcggtgatcagcactgaacacagaggactcaccatggagttctggctgggctgggttttccttgttgcaatttcaaaaggtgtccagtgtgaggtgcagctggtggagaatggagggggcttgatccagccgggggggtccctgagactctcctgtgcagcctctggcttcaccatcagtagagactacatgagctgggcccgccaggctccagggaaggggctggagtgggtctcagttatttatcgcgatgggtggcacacactacgcagacctccgtgaagggcagattcaccgtctccagagacaattccaagaacatggtgtatcttcaaatgaacagactaanagccgaggacacggccgtatattactgtgcgagacatgactacggtgagccctggggccacggggaacccg

SEQ ID NO: 534115 - DNA, 541 bp, Homo sapiens
  misc_feature: HEFZJCU01DG6JY.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattacaaaagacacgctgtatctgcaaatgaacacgcctgacgaaccgaggacacagccgtggtattactgtacacatccctagaacgcgtcaactactactactacggtatggacctcgtcgggaccg

SEQ ID NO: 534116 - DNA, 529 bp, Homo sapiens
  misc_feature: HEFZJCU01D1RKR.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtcgaccgccgcagacacggctgtctattactgtgcgacgggccccgagccgcaggtcggttcgtttttgagttgcctttgattatggttcgggggccgaaggggaccgaagttcgggtctaccggttcttcc

SEQ ID NO: 534117 - DNA, 504 bp, Homo sapiens
  misc_feature: HEFZJCU01EDW0F.49.9.A09.1.454.heavy.3.raw
agtcgagagacacgaccggtgctcgatttagcgagacgcgcgggggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggattcaccttcagggtctatgacatgcactgggtccgccaggctccaggcaaggggctggagtgggtggcagttatatcatatgatggaagcaatatatactatgtagactccgtgaagggccgattcatcatctccagagacaattccgagaacacgctgtatctgcaaatgaacagcctgagagctgaggacacggctgtgtattactgtgcgaacttaatctacggaggacaacggtcgacccccgtccgcgtc

SEQ ID NO: 534118 - DNA, 499 bp, Homo sapiens
  misc_feature: HEFZJCU01BQJ23.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattacgtgtgggagagtagtgggaggtcgatattaggta

SEQ ID NO: 534119 - DNA, 515 bp, Homo sapiens
  misc_feature: HEFZJCU01CAXJC.16.21.B10.1.454.heavy.3.raw
tgtactactccacgaccggtgctcgatttagtgtcgtcgcaggagagaggagcccagccctgggattttcaggtgttttcatttggtgatcaggatgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgacgaaagcaccggcagttagtccacccatacttactttgactacgtggggaccgg

SEQ ID NO: 534120 - DNA, 400 bp, Homo sapiens; identical to SEQ ID NO: 444452
  misc_feature: HEFZJCU01BWG91.47.24.C02.1.454.heavy.3.raw

SEQ ID NO: 534121 - DNA, 535 bp, Homo sapiens
  misc_feature: HEFZJCU01CT3JH.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaatagaacagctgagagccgatgacacggccgtgtattactgtgcgagagagtgggggcccacgaacgttacgtacgtcctatggacgtcgtcgggggccaaggggaccctacc

SEQ ID NO: 534122 - DNA, 520 bp, Homo sapiens
  misc_feature: HEFZJCU01EEGTA.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatgggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcgtcttcccctggcaccctctccaagagcacctctgggggcacgacg

SEQ ID NO: 534123 - DNA, 522 bp, Homo sapiens
  misc_feature: HEFZJCU01C3I2S.3.81.H04.1.454.heavy.3.raw
  modified_base (487)..(487): a, c, t, g, unknown or other
agacgcactccacgaccggtgctcgatttagtagtgtagattcgcgggctggtggagtctgggggaggcttggtccagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttccccctggcaccctcctccaagagcacctctgggggcacagcgcccngggctgcctggcaaggactacttccgagtgcgtct

SEQ ID NO: 534124 - DNA, 522 bp, Homo sapiens
  misc_feature: HEFZJCU01EDQG1.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgtaacgttactacgctatggacgtcgtggggccgaagggaccac

SEQ ID NO: 534125 - DNA, 526 bp, Homo sapiens
  misc_feature: HEFZJCU01DHQ7G.7.28.C06.1.454.heavy.3.raw
  modified_base (339)..(339): a, c, t, g, unknown or other
  modified_base (460)..(460): a, c, t, g, unknown or other
  modified_base (490)..(490): a, c, t, g, unknown or other
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtggggtggccaacataaatgacgatagcaaaggngacctactatttggactctgtgaggggccattcatcatctccagagacaacgccgacaactcactgtctctgctgatgagcagcctgagacggccgacgacgacggctatctattactgtnacgaaactctactacttccgttcatcctanaatacgtggggccgacgggaacccgtggccggtccg

SEQ ID NO: 534126 - DNA, 527 bp, Homo sapiens
  misc_feature: HEFZJCU01CIKX0.47.78.H01.1.454.heavy.3.raw
  modified_base (464)..(464): a, c, t, g, unknown or other
agctcacgtacacgaccggtgctcgatttagtgtgagtagtttgggtttggggctctctgagagtcagggacctcctgcattagcacatgaaacacctgtggttcttccgcctcctggtgacagctcccagatttgactgcctcaggaatgccgatttgaagatgtgagatgctgcctctgatcccaggactcactgcgggtttctctgttcacaggggtcctgtcccaggtgcaaccacaccactggggcgcaggactgttgaagccttcggagaccctgtccctcacctgcgctgtctgtggtgggtccttcagtgactactactgagactagatccgccagtccccagggaaggggctggaatggattcgacaggtcaatcattacagatccaccaactacaacccgtccctcagcagtcgagtcaccttttcgcttgacacgtccaacaaccagttttcncttgatcaaaacccgcgaccgccgcggacacgcctcggcccccgtggggccccagtaaacccg

SEQ ID NO: 534127 - DNA, 532 bp, Homo sapiens
  misc_feature: HEFZJCU01BUH4V.2.53.E09.1.454.heavy.3.raw
acgctcgacacacgaccggtgctcgatttagagagagtgtgttgggtttggggcccctagatcacagctcctcaccatggactggacctggagcatcctttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacaagggcttgagtggatgggatggatcagtgcttacaacggtaacacaaactatgcacagaagttccagggcagagtcaccctgaccacagacacatccacgagcacagtcaacctggacctgaggagcctgacatctgacgacacggccgtgtatttattgtgtcgagaggacggagggggggagcggacgtccgttttgtactactgggggccacggggaacccgtggtccgaccggtctcccttcacggccctcccgacccaaacgggg

SEQ ID NO: 534128 - DNA, 525 bp, Homo sapiens
  misc_feature: HEFZJCU01B2JWM.51.84.H07.1.454.heavy.3.raw
  modified_base (489)..(489): a, c, t, g, unknown or other
cgatcgtatacacgaccggtgctcgatttagcagacgtctgtcgcggggctctgagagaggagcccagccctgggattttcaggtgttttcatgtggtgatcaggactgaacagagagaactcaccatggagtctgggctgacgtggctttttcttgtggctattttaaaaggtgtccagtgtgacgtgcagctggtggagtctgggggaggcttggtacagccgggggggtccctgagactctcctgtacagcctctggcttcacctttagagtctatgacatgagttgggtccgccaggctccggggaaggggctggagtgggtctcaacgatcagtgatagtggaagtaccacaaactacgccgactccgtgaagggccggtggcaccatctccagagacaattcgaaggacactttatatctacaaatcaacaggctgacaaccgcggacacgggcctctattactgtgcgaaagagacggaccnctggacgaggagccagaggagaatcactactttacg

SEQ ID NO: 534129 - DNA, 540 bp, Homo sapiens
  misc_feature: HEFZJCU01BK7O4.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctagtttcttcaaatgaacagcctgagagccgatgacacggccgtgtattactgtgcgagagagtcggggcccaacgaacgtttactacgtctaattgggacgtcgtgggggccaaggggacctacc

SEQ ID NO: 534130 - DNA, 506 bp, Homo sapiens
  misc_feature: HEFZJCU01EKP4B.52.34.D01.1.454.heavy.3.raw
cgcagtacgacacgaccggtgctcgatttagatcgtctgtgttgggtttgggggaggcttggtaaagcgggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaaggcccatcggtcttcccctggcaccctcctccaagagcacctctgggggcacagcggccctgggctgcctggtcaaggactacttcctatacgatcg

SEQ ID NO: 534131 - DNA, 496 bp, Homo sapiens
  misc_feature: HEFZJCU01A4C07.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaaggcgattcatcatctccagagacaactccaacaacacactggatctccaaatgaacagacctgagagtcgaggtacacgggccgtagtattaatttgtcgtcccttggacttacgta

SEQ ID NO: 534132 - DNA, 530 bp, Homo sapiens
  misc_feature: HEFZJCU01A0T2D.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtaatactgtatctggaaatgaacaatctgagagtcgacgatacggctgtctatcattcgtgttttcgagttgccctttcggtccgcggggtacctttctcgggggccgacggggtaaccccg

SEQ ID NO: 534133 - DNA, 532 bp, Homo sapiens
  misc_feature: HEFZJCU01BS26P.16.27.C05.1.454.heavy.3.raw
  modified_base (424)..(424): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttattcatatgatggaactactcaacactatccagactccggggagggccgattcaccgtctccagagacaattccaagtaacagggtgtttcnccaagtgattgatctgagaagtgaggacacggctgtttattacgtgtgcgcggtggctgaccgctcgttgactactgggggccgggtaggccccggtcatcggtctcc

SEQ ID NO: 534134 - DNA, 503 bp, Homo sapiens
  misc_feature: HEFZJCU01BYYR6.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactggtccgccagactccaggcagggggctggagtgggtggcagttatttcatatgatggaaatagtgacttctattcagactccgtgaagggccgattcaccgtctccagagacaattccaggcacacgctgtatctgcaatgaacagcctgagagctgaggacacggtctgtgtattactagtgacgaaagtagtttactatagaggtgacgtacgggggcgttcg

SEQ ID NO: 534135 - DNA, 491 bp, Homo sapiens; identical to SEQ ID NO: 482877
  misc_feature: HEFZJCU01D4B2J.3.34.D01.1.454.heavy.3.raw

SEQ ID NO: 534136 - DNA, 510 bp, Homo sapiens
  misc_feature: HEFZJCU01EB3A4.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggttcagggcagggtcaccatgaccagggacacgtccatcagtacagcctacatggagctgagcagtctgacgacctgacgacacggccgtcgtattattgtgtcgttaggtttacggacgtattacgacgtttttagagtttggtacc

SEQ ID NO: 534137 - DNA, 523 bp, Homo sapiens
  misc_feature: HEFZJCU01E06OO.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaacgaacacgctgtttccttcaaatgaacagcctgagagccgatgacacggccgtgtattactgtgcgagagatggggcccacggaacgttactacgctatggacgtctggggccgaagggaccg

SEQ ID NO: 534138 - DNA, 485 bp, Homo sapiens
  misc_feature: HEFZJCU01A94II.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaacgggcccatcggtcttccccctggccaccctcctccaagagcacctctgggggcacagcggccctgggctgcctggtcaaggactacttcctagagacacg

SEQ ID NO: 534139 - DNA, 540 bp, Homo sapiens
  misc_feature: HEFZJCU01D1M09.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattacttgtgcgcggtggcgtcgaccgctcttgtactacgtcggggggccgggggacggccccgggtctactcgtcct

SEQ ID NO: 534140 - DNA, 347 bp, Homo sapiens; identical to SEQ ID NO: 450801
  misc_feature: HEFZJCU01BJ27Z.52.78.H01.1.454.heavy.3.raw

SEQ ID NO: 534141 - DNA, 500 bp, Homo sapiens
  misc_feature: HEFZJCU01BVHB9.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatgacagaactttcagggcagggtcaccatgacctgggacgcgtccatcagcacagtctacatggatctgagcggactgacctctgacgacacggccatgtattactgtggaagagacggttgtggctaccgcggggctgaccacgtggggccg

SEQ ID NO: 534142 - DNA, 506 bp, Homo sapiens
  misc_feature: HEFZJCU01BOYF2.10.38.D05.1.454.heavy.3.raw
  modified_base (295)..(295): a, c, t, g, unknown or other
  modified_base (476)..(476): a, c, t, g, unknown or other
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccnccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggcacctattattgtgcgcgacatnactacgctcaattctaggggccaggggacg

SEQ ID NO: 534143 - DNA, 526 bp, Homo sapiens
  misc_feature: HEFZJCU01CV7AY.18.85.H08.1.454.heavy.3.raw
tacgagtatgcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcagtttcagtgcctactggatgcactggatccgccaagttccagggaagagactggtgtgggtctcacgtattaaagatgatgggggtgccacatcctacgcggactccgtgaggggccgcttcaccatctcccgagacaacaccaagaacacgctgtatctgctaaatgagcagtctgggatcgaggacacggctgtctattactgtgcaagaggggactacgggtgccctacggagggggttggtccgaccccgtggggccaggggaacccctggtcaccgttctccctcacg

SEQ ID NO: 534144 - DNA, 518 bp, Homo sapiens
  misc_feature: HEFZJCU01BX1PZ.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttctgtgcgagatctttcgatttttggagtggtaacccccttggctactggggcaggaaccctggtcacgtctcttcagcctccacc

SEQ ID NO: 534145 - DNA, 415 bp, Homo sapiens; identical to SEQ ID NO: 478862
  misc_feature: HEFZJCU01B0ELD.40.81.H04.1.454.heavy.3.raw

SEQ ID NO: 534146 - DNA, 527 bp, Homo sapiens
  misc_feature: HEFZJCU01B48NZ.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcgagcagcgactgtattgcctgggtccgccaggctccagggaagaggccggagtgggtcgcagggtatttttatagggtgggacgacattctacggagactccatggagggccgattcaccatctccagagacttttctcagaacacactgtctcttcaaattgaacagccctgaggggccgagggacacgggccttcgtatttattgtgtgagagttttatggcgattggctgggtggacaggatcactggggccac

SEQ ID NO: 534147 - DNA, 531 bp, Homo sapiens
  misc_feature: HEFZJCU01B7290.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctggagaaccgacgaccacggccgtactattattggtgttcataggacctagggataaccaacggtacggtggtacctgggtattcc

SEQ ID NO: 534148 - DNA, 521 bp, Homo sapiens
  misc_feature: HEFZJCU01ES0SS.52.53.E09.1.454.heavy.3.raw
cgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagtctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccgagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgttctattactgtgcgagagaacccgaggggggcgggagtcgacgccccgtaacttc

SEQ ID NO: 534149 - DNA, 515 bp, Homo sapiens
  misc_feature: HEFZJCU01BQERH.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtgggggccccacgaaccgttactaccgctagtggacgtcgtgggg

SEQ ID NO: 534150 - DNA, 376 bp, Homo sapiens
  misc_feature: HEFZJCU01CQC24.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggcctgggctgcctggtcaaggctacttctacgtgagct

SEQ ID NO: 534151 - DNA, 518 bp, Homo sapiens
  misc_feature: HEFZJCU01DX38B.40.43.D10.1.454.heavy.3.raw
  modified_base (342)..(342): a, c, t, g, unknown or other
tctagcgactcacgaccggtgctcgatttagactagcagtaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggagtctgggggaggcttggcacagcctggggggtcccggagactctcctgtgcagcctctggattcgcctttcagaactctgccatgcactgggtccgccagcctccagggaaggggctggagtgggtctcaggtattcgggggtnatggtactgacacatactacgcagactctgcgaagggccggttcaccatctccagagacatttccaagaacacactctatctgcaaatgaccaacctcagaggcgaggacacggccatattattactgtgacgaaggtggtgactatcgaccacgtgggccgaggaccctgtaccg

SEQ ID NO: 534152 - DNA, 511 bp, Homo sapiens
  misc_feature: HEFZJCU01CIH93.11.13.B02.1.454.heavy.3.raw
  modified_base (480)..(480): a, c, t, g, unknown or other
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggaggggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgcctgctccnggagcacctccgagagcacagcggccctggg

SEQ ID NO: 534153 - DNA, 516 bp, Homo sapiens
  misc_feature: HEFZJCU01DTXAM.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggttaggacgcctacggcagccggcctttgaccttctgggggccaggggacg

SEQ ID NO: 534154 - DNA, 484 bp, Homo sapiens
  misc_feature: HEFZJCU01DBD4D.53.33.C11.1.454.heavy.3.raw
  modified_base (471)..(471): a, c, t, g, unknown or other
  modified_base (475)..(475): a, c, t, g, unknown or other
cgcgtatacacacgaccggtgctcgatttagagtgagctcgttgggtttggggagacgagcccagcactggaagtcgccggtgtttccattcggtgatcatcactgaacacagaggactcaccatggagtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacgctgtgtattactgtgcgngtgngatgtctta

SEQ ID NO: 534155 - DNA, 500 bp, Homo sapiens
  misc_feature: HEFZJCU01EBPTI.4.19.B08.1.454.heavy.3.raw
agcactgtagcacgaccggtgctcgatttagtgagtcagtaaggggtgggagaggagcccagcactggaagtcgccggtgtttccattcggtgatcagcactgaacacagaggactcaccatggagtttgggctgagcgtggtcttcctcgttgttcttttaagaggtgtccagtgtcaggtgaaattggtggactctgggggaggcgtggtccagcctgggaggtccctgagactctcctgtatagcctctggattcaccttcggcagttatgctatgcactgggtccgccaggctccaggcaaggggttggaggtgggtggcagcaatatcatatgatggaagtgataaatattacatagagtccgtgaagggtcgattcaccatctccagagacaatcgcaagaacacactgtatctggaatgaccagcctgagaggtgacgacacgggtgtttattacttgtgcgcgggataggaggctcatcgtggatacaactt

SEQ ID NO: 534156 - DNA, 508 bp, Homo sapiens
  misc_feature: HEFZJCU01DMU44.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtggtagcataggctatgcggactctgtgaagggccgattcaccatctcagagacacgccaagaactccctgtactctgcaaatgaacagcctgagagctgaggacacggccttgttattatttgtgacaaaaggactaccctaaccccttacgtt

SEQ ID NO: 534157 - DNA, 512 bp, Homo sapiens
  misc_feature: HEFZJCU01BEY0A.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatcctccagagacaattccaggaacacaatgtatttggagctgaacagcctaagtcctgaggacacgggcgtagtactactgtacgaagggagggggaaccgagcgggagttccaagtactcctt

SEQ ID NO: 534158 - DNA, 540 bp, Homo sapiens
  misc_feature: HEFZJCU01D47LG.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctactggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacactccctgaaagcgtcaactactaactacctacggtatggacctctcgggaccg

SEQ ID NO: 534159 - DNA, 511 bp, Homo sapiens; identical to SEQ ID NO: 523455
  misc_feature: HEFZJCU01AVQ74.15.67.G01.1.454.heavy.3.raw

SEQ ID NO: 534160 - DNA, 505 bp, Homo sapiens
  misc_feature: HEFZJCU01DWIG3.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattcccaagaacacgcagtatctgcaaatgaaacagcctgagagctggaggacacggctgtcgtatttactggttaggggagagatgggaggtcgaatatttgta

SEQ ID NO: 534161 - DNA, 527 bp, Homo sapiens
  misc_feature: HEFZJCU01CJBIF.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtccttgaggacacggggtcgtactactaccttgtaccgtaaggaggggggaaccgaggcgggaggttccaagtactccttttgtacg

SEQ ID NO: 534162 - DNA, 517 bp, Homo sapiens
  misc_feature: HEFZJCU01C3YTM.26.12.B01.1.454.heavy.3.raw
  modified_base (420)..(420): a, c, t, g, unknown or other
  modified_base (497)..(497): a, c, t, g, unknown or other
agactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccagggaggggcctggagtgggtctcaggtatcagttacaatagtggtaatatactctatgcggactctgtgaagggccgtattcgaccatctccagagacaacgccaggaactccctntatctagaaatggacagtctgacaactgaggacacggtccttttattctgtgcaaaggtggaaccacatatttcaanagctaggcactggtactacg

SEQ ID NO: 534163 - DNA, 522 bp, Homo sapiens
  misc_feature: HEFZJCU01ASA6W.48.34.D01.1.454.heavy.3.raw
  modified_base (473)..(473): a, c, t, g, unknown or other
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcacttttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaacgggcccatcggtcttcccccttcggcgtcccgtgctccacggagcncctccgagagcacagcggcctgggctgcctggtcaaggactactttacc

SEQ ID NO: 534164 - DNA, 523 bp, Homo sapiens
  misc_feature: HEFZJCU01DURUM.49.81.H04.1.454.heavy.3.raw
agtcgagagacacgaccggtgctcgatttagtagtgtagattcgcgggggggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctggggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgtattcaccatctccagagacaattccaagaacacgctatatttgcacatgaacagcctgagagctaggaggacacggctatttattactgtgcgaacttaatcacggagacgagggtcgaccccgtcacgtcggtacggtacg

SEQ ID NO: 534165 - DNA, 494 bp, Homo sapiens
  misc_feature: HEFZJCU01BIGOV.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgacgagtcgaggacgaccggccgtatacttatttgtggtcccttgattacta

SEQ ID NO: 534166 - DNA, 428 bp, Homo sapiens
  misc_feature: HEFZJCU01EAXPB.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgacctacagcggtggcacaaagtatgcacagaagtttcagggcaggggtcaccatgaccagggacacgtccatcagcacgtccatcagcacagcctacatgga

SEQ ID NO: 534167 - DNA, 537 bp, Homo sapiens
  misc_feature: HEFZJCU01D98ZJ.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatgggttggggggtaggtttggggtttttttttacgttacgttacgggat

SEQ ID NO: 534168 - DNA, 501 bp, Homo sapiens
  misc_feature: HEFZJCU01DRRJI.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatggtctttcacagtgggaggactgactacaacgcctccctcaggagtcgggtcaccatatcagtagacacgtccaagagccagttctccctgaagctgagggctgtgagcgccgcagacacggcgtgtattactgtgcgagactggccgcaacagactacggtggcaactcctatgtctttgatatcgtggggccaagggac

SEQ ID NO: 534169 - DNA, 514 bp, Homo sapiens
  misc_feature: HEFZJCU01AOL98.52.24.C02.1.454.heavy.3.raw
  modified_base (490)..(490): a, c, t, g, unknown or other
cgcagtacgacacgaccggtgctcgatttagtacagatcgtgggaaaggggctctgagagaggagccttagccctggattccaaggcctatccacttggtgatcagcactgagcaccgaggattcaccatggaattggggctccgctgggttttccttgttgctattttagaacggtgtccagtgtgaggtgcagctggtggagtctgggggaggcctggtcaagccggggggtccctgagactctcctgtgcagcctctggattcaccttcagcagttatagcatgaactgggtccgccaggctccagggaagggctggagtgggtctcatttattagtactagttacttatactacgcagactcagtgaagggccgattcaccatctccagacgacaacgccaggaattcactatatttgcaaatgaacagcctgcgagccgaggtacacggctgtagtattacgtgtgtcgcgagaacacagacaancggacagtttcgactacgtgggcc

SEQ ID NO: 534170 - DNA, 503 bp, Homo sapiens
  misc_feature: HEFZJCU01EQAXV.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacagggcccccggacaagggcttgagtgggtggggtgggtcagcggctttgacggtaaggcacagtatgcaccgaagatgaagggcagagtcacgattaccacggaccacccccacgaacacagtctacatgcaactgacgagcctgagagctgacgacacggccgtctattactgtgcgagaatgttttctgtcatcgtacaatttgataggctctatggactggacttcgt

SEQ ID NO: 534171 - DNA, 422 bp, Homo sapiens
  misc_feature: HEFZJCU01D27VR.16.78.H01.1.454.heavy.3.raw
tgtactactccacgaccggtgctcgatttagtgtgagtagtttgggtttggggcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccggtaacttcgggggactacctcgacccctggggccagggaatactggtcaccgtctcctcagcctccaccaagggcccatcggtcttccccctggcaccctcctccaagagcacctctggggcacagcggccctgggctgcctggtcaaggactacttccgagtagtaca

SEQ ID NO: 534172 - DNA, 506 bp, Homo sapiens
  misc_feature: HEFZJCU01D15I2.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattatttgtgcgcgacatgactacgctcaattctggggccagggacg

SEQ ID NO: 534173 - DNA, 511 bp, Homo sapiens
  misc_feature: HEFZJCU01DLMP6.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttggggtccggcagtcccccaacacagggactgcagtggattggatacatctacttcagtgggaaccccaactacaacccctcctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacgggtcatcgtctcctcagcctccaccaagggcccatcggtcttcccctgg

SEQ ID NO: 534174 - DNA, 517 bp, Homo sapiens
  misc_feature: HEFZJCU01CL3J0.48.57.F02.1.454.heavy.3.raw
agtatacatacacgaccggtgctcgatttagctcgatatagttgggtttggggacccaacaaccacacccctcctaagaagaagcccctagaccacagctccacaccatggactggacctggaggatcctcttcttggtggcagcagcaacaggtgcccactcccaggtgcagttggtgcaatctgggtctgatttgaagaagcctggggcctcagtgaaggtttcctgcagggcttctggatactccttcactgactatggtatcaattgggtgcgacaggcccctggccaagggcttgagtggatggggtggatcgacaccaacactgggaacccaacacatgcccggggcttcaaggacggtttgacttctccttggccacctctgtcagcacggcatatctgcagatcagcagcctaaagcctgaggacactgccgtgttttattgtgcgagatccaggcgaggaggataccggattcttatatagcgactactactacttcggaatggtacg

SEQ ID NO: 534175 - DNA, 530 bp, Homo sapiens
  misc_feature: HEFZJCU01EDY8Y.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggccgcctgctccaggagcacctccgagagcacagccggcccgtcgggctgcctggtcaaggactacttcctac

SEQ ID NO: 534176 - DNA, 530 bp, Homo sapiens; identical to SEQ ID NO: 447821
  misc_feature: HEFZJCU01DGWEH.12.40.D07.1.454.heavy.3.raw

SEQ ID NO: 534177 - DNA, 499 bp, Homo sapiens
  misc_feature: HEFZJCU01EDW1F.10.71.G05.1.454.heavy.3.raw
catagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctgggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaaggccgattcaccatctccagagacaattccaagaacatggtgtatctgcaatgacagcctgagagcgaggacacgggtgtttattactcgttgggagtaaagtcctagtggctacg

SEQ ID NO: 534178 - DNA, 502 bp, Homo sapiens
  misc_feature: HEFZJCU01DBF07.17.10.A10.1.454.heavy.3.raw
  modified_base (485)..(485): a, c, t, g, unknown or other
cgtagactagcacgaccggtgctcgatttagcgtcgatctcaggggacccaaaaaccacacccctccttgggagaatcccctagatcacagctcctcaccatggactgggcctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggcctntatggatggacttcgtc

SEQ ID NO: 534179 - DNA, 503 bp, Homo sapiens
  misc_feature: HEFZJCU01EEI1T.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagacctgagagccggaggacaacgggtgtttattactgtgggagaaatcctagtggactacg

SEQ ID NO: 534180 - DNA, 513 bp, Homo sapiens
  misc_feature: HEFZJCU01E0TV7.9.34.D01.1.454.heavy.3.raw
  modified_base (470)..(470): a, c, t, g, unknown or other
  modified_base (510)..(510): a, c, t, g, unknown or other
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggccggggaaccctggtcgccgtctcctcagcctccaccaaggcccatcggtcttcccctggcaccctcctccaagagcacctctgggggcncagcgcctggctgcctggtcaaggactacttccagacgtntca

SEQ ID NO: 534181 - DNA, 521 bp, Homo sapiens
  misc_feature: HEFZJCU01ANCLZ.14.71.G05.1.454.heavy.3.raw
cgtctagtaccacgaccggtgctcgatttagtgtcgtcgcaagagagaggggcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctgggggggtccctgagactctcctgtgcagcctctggattcgtctttagcagctatgccatgagctgggctcgccaggctccagggaaggggctggagtgggtctcgtgctattcctggcagtggtgatatcgaatactacgcagactccgtgaagggccggttcactgttccagagacaattccaagaacacactgtatctgcagatgaccagcctgagaggccgaggacacgggccgtagtattactggtgtacgaaaccgccaagtagtttttggagttggttattattacctttgacttcgttc

SEQ ID NO: 534182 - DNA, 519 bp, Homo sapiens
  misc_feature: HEFZJCU01EDVRA.10.85.H08.1.454.heavy.3.raw
  modified_base (466)..(466): a, c, t, g, unknown or other
  modified_base (480)..(480): a, c, t, g, unknown or other
catagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccaccgaggctccagggaaggggctggagtgggtggccaccataaaggaagatggaagtgagaactacttgtggctctgtgaaggccgattcaccatctccagagacaacgccaagaagtcactgtatctgcaaatgaacgatgtgagagtcgaggacacggctgtatatttctgtgnggaggggagccggntagtggttccggacctcgtggggccaggggaaccctggt

SEQ ID NO: 534183 - DNA, 533 bp, Homo sapiens
  misc_feature: HEFZJCU01EOFOO.49.78.H01.1.454.heavy.3.raw
  modified_base (500)..(500): a, c, t, g, unknown or other
agtcgagagacacgaccggtgctcgatttagtgtgagtagtttgggtttgggctgagctgggttttccttgttgctattttaaaaggtgtccagtgtgacgtgcaggtggtggagtctggggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactgggccagggaaccctggtcaccgtctcctcagcctccaccaagggcccatcggtcttccctggcgcctgctccnggagcgtacctccgacggagccacagcggcccg

SEQ ID NO: 534184 - DNA, 496 bp, Homo sapiens
  misc_feature: HEFZJCU01C1IFY.10.38.D05.1.454.heavy.3.raw
  modified_base (247)..(247): a, c, t, g, unknown or other
  modified_base (344)..(344): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctcgggggggtccctggagactcncctgtgcagcctctgggttcagcatcagtaacgactacatgacctgggcccgccaggctccgagggaagggctggagtggtctcagttattgaaacngatggcactacatattattctgactccgtgaagggccgttcaccctctccagagacacttccaactaacatcttgtaatcttcacgatcgcaccaatccgtagagacggtacgaacgacaccgggccaaccctattaactttgtcgcgaccg

SEQ ID NO: 534185 - DNA, 552 bp, Homo sapiens
  misc_feature: HEFZJCU01DGJ3U.13.35.D02.1.454.heavy.3.raw
tcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctgggggggcttggttaagcctggggggtccctcagactctcctgtgcaacctctggattcattttctctgacgcctggttgagctgggtccgccaggctcccgggaaggggctggagtgggttggccgtattaaaggtagaagacatggtcggacaacagactacagtgttcccgtgaaaggcagattcactatctcaagagatgactcaaaagaatgatatatctgcaaatgaacaacctgaaaagcgaggacacaggcgtgtattactgtacctacgagatgggccagagtgacgaaatcgggccgccggacgaaggtttcgaactacctgggggccccgggtaac

SEQ ID NO: 534186 - DNA, 530 bp, Homo sapiens
  misc_feature: HEFZJCU01B15RW.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttgccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacactccctgaaagcgtcaactactactactacggtatggacctcgt

SEQ ID NO: 534187 - DNA, 528 bp, Homo sapiens
  misc_feature: HEFZJCU01CGG4G.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaatagacagcctgagaccagacgacacggcctgtctattattgcgcgagagagacacacgaacctactggccaatactatgggggcttgttctgggccaggggaccctggtcatcgtctccccgagcctccaccaagggcccactcggtcttccccctgccgcctcg

SEQ ID NO: 534188 - DNA, 497 bp, Homo sapiens
  misc_feature: HEFZJCU01BITX2.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccaacaaactatgcacagactttttcgagggcgtgggtcaccatgaccagcgacacatctagcaacacagtctacatggagttgaccagcctgaccgacaccggccgtgtatttttagtgtgagagtatttttcggacaactccagacgacccct

SEQ ID NO: 534189 - DNA, 515 bp, Homo sapiens
  misc_feature: HEFZJCU01CCIWQ.26.12.B01.1.454.heavy.3.raw
agactatactcacgaccggtgctcgatttagtagtgtagattccgcgggggggagaggagccccagccctgagactcccaggtgcttccattcagtgatcagcactgaacacagaggactcaccatggagttgggactgaactggatttttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccagggaggggcctggagtgggtctcaggtatcagttacaatagtggtaatatactctatgcggactctgtgaagggccgattcaccatctccagagacaacgccaggaactccctctatctagaaatggacagtctgacaactgaggacacggccttttattctgtgcaaaggtggaaccgacatatttcacaagctggcactggtacttcg

SEQ ID NO: 534190 - DNA, 552 bp, Homo sapiens
  misc_feature: HEFZJCU01BX68S.40.16.B05.1.454.heavy.3.raw
tctagcgactcacgaccggtgctcgatttagagctcacgtaagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgcccgccgggcagggactggagtggattgggcgcgtctatcacagtgaaaccagctacatcccctccctcgagagtcgagtcaccatttcactagacacgtccacaaatcagttgtccctgaggctgagctctgtgaccgccgcggacacgggcgtatattactgtgcgaggaggggggccggggggaaactccgtatggctcctttgactactgggggccaggggaaccctgggtcctacccggtctcctcacgcctccaccgagggtaccccagtccggtccttcccccgtggccgccctcgcctaccacggagctacccg

SEQ ID NO: 534191 - DNA, 344 bp, Homo sapiens
  misc_feature: HEFZJCU01C41Z0.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagctacaggaggactcaccatggaattggggctgagctgggttttactgttggtatttagaaggtgtccagtgtgaggtcgcacgctggtggagtcccgggggggaggtctggggtccagcctggggggtccctgagactctcctgttcagcctctggtatcctacctttagtagggttttggatgagtt

SEQ ID NO: 534192 - DNA, 435 bp, Homo sapiens
  misc_feature: HEFZJCU01ELDLD.3.21.B10.1.454.heavy.3.raw
agacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgccaactgaagtctgtgactcccgaggacacggctgtttattactgtgcaagagcgaggaggagcagttttgacagctgggaccagggaaccctggtcaccgtctcctcagcctccaccaagggcccatcggtctcccctggcgccctgctccaggagcacctccgagagcacagcggccctgggctgcctggtcaggactacttccgagtgcgtct

SEQ ID NO: 534193 - DNA, 502 bp, Homo sapiens; identical to SEQ ID NO: 451203
  misc_feature: HEFZJCU01CX9OA.10.38.D05.1.454.heavy.3.raw

SEQ ID NO: 534194 - DNA, 502 bp, Homo sapiens
  misc_feature: HEFZJCU01B6IOT.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacagggggtttgagtggatggggtggatcaaccctaccagaggtggcacaaagtatcgacagaactttcagggcagggtcaccatgacctgggacgcgtccatcagcacagtctacatggatctgagcggactgacctcgtgacgacacggccatgtattactgtggaagagacgttggtggctaccgcggggctgaccacgtcgggcc

SEQ ID NO: 534195 - DNA, 515 bp, Homo sapiens
  misc_feature: HEFZJCU01CGXRI.40.81.H04.1.454.heavy.3.raw
tctagcgactcacgaccggtgctcgatttagtagtgtagattcgcggggatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgaccttcgtgacgacacggccatgtattactgtggaagagacgttgggtggcctaccggcgggggctgaccacgtcggggccgacgggaacccg

SEQ ID NO: 534196 - DNA, 535 bp, Homo sapiens
  misc_feature: HEFZJCU01BM9GS.17.28.C06.1.454.heavy.3.raw
  modified_base (406)..(406): a, c, t, g, unknown or other
  modified_base (522)..(522): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtggccaacataaagcaagatggaactgccgagttttacgtggactctgtgaagggccgttcaccatctccagaganaacgccaagaattcactgtatctacactgaacagcctgagagtcgtagacacggccgtgtattactgtgcgagatgtggaaaaagtatggctgtgttttagttggggccagggganccctggtcaccgt

SEQ ID NO: 534197 - DNA, 502 bp, Homo sapiens
  misc_feature: HEFZJCU01A3S0X.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgttgttttcgatgtccttcgggtccgcgggtacttcgt

SEQ ID NO: 534198 - DNA, 519 bp, Homo sapiens
  misc_feature: HEFZJCU01CV87Q.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtccttcccctggccaccctcctccagagcacctcgtggggcacagcggcccgtgggctgcctggtcaaggactacttccgagtagtac

SEQ ID NO: 534199 - DNA, 513 bp, Homo sapiens
  misc_feature: HEFZJCU01CQ1Q6.12.25.C03.1.454.heavy.3.raw
  modified_base (499)..(499): a, c, t, g, unknown or other
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttcctcaggtatactattgcctgggtgcgacaggcccctggacaaggcttgagtggatggggtggatcaacgtacagactggtggcacagactatgcacaggggctccagggcagactcaccatgaccacagacacatcagcgaacacagtcaacatggagttgcgagcctgcgatctgacgacgcggccgtatattactgtgcgagagtacgtagcggctcgcctttgactactggggcctgggtaacncgtgtcgaccgtct

SEQ ID NO: 534200 - DNA, 494 bp, Homo sapiens
  misc_feature: HEFZJCU01AS9NR.10.29.C07.1.454.heavy.3.raw
catagtagtgcacgaccggtgctcgatttagagtgctacgaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggaatccccttcagtacctatggcatgcactgggtccgccaggctccaggcaaggggctggagtgggtggcagccatatcgtatgatgtaactaataaatactatgcagactccgtgaagggccgattcaccatctccagagacaatttcaagaacacgctgtttctgcaaatgaacagcctgagagctgaggacacggctgtgtattactgtgcgaaagatatcgcggtgtacc

SEQ ID NO: 534201 - DNA, 508 bp, Homo sapiens
  misc_feature: HEFZJCU01EMCC9.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggcccgtgtattactgtgcgagagatggggcccacgaacgttactacgctatggacgtcgt

SEQ ID NO: 534202 - DNA, 529 bp, Homo sapiens
  misc_feature: HEFZJCU01C2048.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggaccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatccggtctccccagcctccaccaacgggcccagtccggtcttcccccgtggccg

SEQ ID NO: 534203 - DNA, 508 bp, Homo sapiens
  misc_feature: HEFZJCU01C5SVV.40.81.H04.1.454.heavy.3.raw
  modified_base (461)..(461): a, c, t, g, unknown or other
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagtaactttcagggcagggtcaccatgacctgggacgcgtccatcagcacagtctacatggatcgtgagcggactggacctacgtgacgaacacgggccatgtattacngtaggaagagacgttggtggctaccgcgggctgaccactggggcccg

SEQ ID NO: 534204 - DNA, 484 bp, Homo sapiens
  misc_feature: HEFZJCU01DMLO8.40.83.H06.1.454.heavy.3.raw
tctagcgactcacgaccggtgctcgatttagatcacgtgcgtcgcgggggggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccactgtctggtcggatgaaagttatgcatactatgcagactctctgaggggccgattcatcatctctagagacaattacgaagaacacggcttatctgcaaatagaacagcctagacgagtcgaggacacggctgtattatttctgtgcgaatgaggaa

SEQ ID NO: 534205 - DNA, 547 bp, Homo sapiens
  misc_feature: HEFZJCU01EDZX1.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaacccccacctatgcccaggccttcacagggcggtttgtcttctccatggatacctctgtcgggacggcttatctgcagataaccaaccttcaacctgacgacactgtccgttttagttttgtacgagagcgtcgtcgtgtcgagtaggaattgactacgtggggccgagggaacccgtggtaccaccgtctcctcacgtcctcccaccgaacgg

SEQ ID NO: 534206 - DNA, 545 bp, Homo sapiens
  misc_feature: HEFZJCU01B3UFL.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggcgattcaccatctccagagacaactccaggaacacaatgtatttggtacctgaacagcctaagtcctgaggacacgggtgtagttactactgttacggaagggacgggggggaaccaggaccggggaggtttccaaagtaccgttaccttttcgtacgtccttc

SEQ ID NO: 534207 - DNA, 517 bp, Homo sapiens
  misc_feature: HEFZJCU01DFWKE.15.23.C01.1.454.heavy.3.raw
tctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccagccgggggggtccctgagactctcctgtgccgcctctggactcacctttagtagctattggatgagctgggtccgccaggctccagggaaggggctggagtgggtggccaacataaaggaagatggaagtcagaaacactatgtggactctgtgaagggccgattcaccatctccagagacaacgccaagaattcagtgtatctgcaaatgaaacagcctgagagccggaggacacggccgtgtattactgtgtgagagacatgacaacggtgaataaccggaggggttgt

SEQ ID NO: 534208 - DNA, 526 bp, Homo sapiens
  misc_feature: HEFZJCU01C24EM.16.87.H10.1.454.heavy.3.raw
  modified_base (476)..(476): a, c, t, g, unknown or other
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgnggaacagttatggttggggggagttgggttttttttcgttacttacggga

SEQ ID NO: 534209 - DNA, 538 bp, Homo sapiens
  misc_feature: HEFZJCU01BIX8L.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtcccagggaagggcctggagtggcttggttatgtccaccacagagggatcccttactacaacccgtcactcaagagtcgacttaccatatcactcgacacgtccaggaatcagttctccctgaaactgaggtccgtcattgtcgcgacacagccgtctattattgtgttcagagatccgggcccataactggtctcggccctcgggggcccgggaaccctggtcaccgtctcctcagcctccaccaagggcccatcggtcttcccctggccaccctcctccagacg

SEQ ID NO: 534210 - DNA, 488 bp, Homo sapiens
  misc_feature: HEFZJCU01BRLB0.3.48.E04.1.454.heavy.3.raw
  modified_base (239)..(239): a, c, t, g, unknown or other
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctnagactctcctgtgcagcgtctggattcagtttcgctacacatggcatgcactgggtccgccgagtctccaggcaaggggctgcagtgggtggcgtttattcgaagcgatgggactcatgaacaatatgcagactccgtgaagggccgattcatcatctccacgagacaactccaacaacacactggatctcaatgaacagcctgagagtcgaggacacggccgtactattattgtgcccttgattacta

SEQ ID NO: 534211 - DNA, 528 bp, Homo sapiens
  misc_feature: HEFZJCU01BNYXR.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgtagttatatgaccgccgcagacacggccgtgtacttactgtgcgagagaggccgtttattttacggaccagctagtttaaaaacctcctaactacgtctggacgtcgtcggggaccgagggggacc

SEQ ID NO: 534212 - DNA, 524 bp, Homo sapiens
  misc_feature: HEFZJCU01BXH97.52.20.B09.1.454.heavy.3.raw
cgcagtacgacacgaccggtgctcgatttagtgtagtgtgaaggggggaagaggaagactgacggtccccccaggagtttgggctgagctgggttttcctcgttgctcttttaagaggcgtccagtgttatgtgcagctggtggagtctgggggaggcgtggtccagcctgggaggtccctgagactcgcctgtaaaccgtccggatttaccttcagtaactatgcaatgcactgggtccgccaggctccaggcaaggggctggactgggtggcagctatatcatttgatggaagcaataaatactacgcagactccgtgaagggccgattcaccatttccagagacagctccgataacacggtctatctgcgaatgaacagcctgagacctgagacacggctcttttttactgttgcgccaggaagcagtggctggccacatgatgcttttgatatctggagccaagggacatggttcatcgtctcgtcggccttccaccagggcccatccggtcttcccccg

SEQ ID NO: 534213 - DNA, 505 bp, Homo sapiens
  misc_feature: HEFZJCU01DRUN4.48.25.C03.1.454.heavy.3.raw
agtatacatacacgaccggtgctcgatttagtagtgtagatttgggtttgggggctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaatgagcgcctgagacctgacgacacggctgtctattactgtgcgaggaggcgtccgagttaacatgccgtcggga

SEQ ID NO: 534214 - DNA, 513 bp, Homo sapiens
  misc_feature: HEFZJCU01D9CX6.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagccgtgagatttgacgacacggccatatattactgtgcgagagattgggccgacggaaaccttgactactggggccaggggaaccctggtcaccgt

SEQ ID NO: 534215 - DNA, 509 bp, Homo sapiens
  misc_feature: HEFZJCU01BYWYE.4.30.C08.1.454.heavy.3.raw
  modified_base (416)..(416): a, c, t, g, unknown or other
  modified_base (479)..(479): a, c, t, g, unknown or other
agcactgtagcacgaccggtgctcgatttagtctgacgtcaaagggaaaggggctcagagaggagccttagccctggactccaaggcctttccacttggtgatcagcactgagcacagaggactcaccatggaattggggctgagctgggttttccttgttgctattttagaaggtgtccagtgcgaggtgcagctggtggagtctgggggaggcttggtccagcctggggggtccctgagactctcctgtgcagcctctggattcacctttactacctattggatggactgggtccgccaggctccagggaaggggctggagtgggtggccaacataaaccaagatggaagtgaacagtactatgtggactctgtgaagggccgattcacatctccagagacaacgccaagaacncactgtatctgcaaatgaacagcctgagagccgaggacacggctatttatactgtgtgaaagngaactggttcttcgatctctggggcctggg

SEQ ID NO: 534216 - DNA, 533 bp, Homo sapiens
  misc_feature: HEFZJCU01AUK1R.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctgggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacgagtggcagctccaagtactactttgacttctggggccagggaaccctggtcaccgtctcctcagcctccaccaggcccatcggtcttcccctcggccgccctcgctccaggacgcacctccgacgacg

SEQ ID NO: 534217 - DNA, 482 bp, Homo sapiens
  misc_feature: HEFZJCU01BPCQR.11.63.F08.1.454.heavy.3.raw
cgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaaccctaatagtggtggcacaaactatgcacagaagtttgagggcagggtcatcatgaccagggacacgtccatcagcacagcctacatggagctgagcaggctgacatctgacgacacggccgtgtattactgttgcgagagataaaggggattggtgatacg

SEQ ID NO: 534218 - DNA, 535 bp, Homo sapiens
  misc_feature: HEFZJCU01BO560.19.48.E04.1.454.heavy.3.raw
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccgggaaggggccggagtgggtggccaacataatgcaagatggaactgagaaaaactatggggactctgtgaagggcgattcaccatctccagagacaaccgtaagaacttactgtttctgcaatgaacagcctgagagccgaggacacggcgtgtgtattattgtgtcgaagggcagtggcgtgggtacatggacgtctgggggccaagggaccaacggtcaccgtt

SEQ ID NO: 534219 - DNA, 544 bp, Homo sapiens
  misc_feature: HEFZJCU01DGZL0.48.34.D01.1.454.heavy.3.raw
  modified_base (521)..(521): a, c, t, g, unknown or other
agtatacatacacgaccggtgctcgatttagatcgtctgtgttgggtttggggggggagaggagcccagcactgggattccgaggtgtttccattcggtgatcagcactgaacacagaggactcaccatggagttttggctgaggtgtccagtgtgaggtgtagctggtggagtctggaggaggcttgccccagcctgggaggtccctaagactttcctgtgcagcctctgggtttagtgtcactagtaggaagatgacttgggtccaccaggctccagggaaggggctggagcgggtcgcaattctttacagtggtgttaggacaacctacgctagactccgtgaaggggcgattcaccttctccagaggcaattccaagaacaccctgtgtcttcgtgggtctcatttcttatagcggtgttaggacaacctacgcagactccgtgaaggggcgattcgaccttctccagaggcaattccaaagaaccacctgtatcttcaaataaacagtactaaganccgaggacacggccctgtgttac

SEQ ID NO: 534220 - DNA, 416 bp, Homo sapiens
  misc_feature: HEFZJCU01BZ8SP.11.37.D04.1.454.heavy.3.raw
cgagagataccacgaccggtgctcgatttagtagcatactgttgggtgcgacaggcccctgggcaaggacttgagtggatgggacagatccacccttacactggcgacacaatttatgcacagaaatttcagggcagatttaccctgaccgaggacacggccatcaccacagtctacatggacctgaagagactgacaattaacgacacggccaaatattattgtgtcagagacaagactcaattttgtgttcgtggtcactgctggttcgacccctggggccagggaaccctgatcaccgtctcctctgcctccaccaagggcccatcggtcttccccctggcaccctcctccaagagcacctctgggggcacagcggccctgggctgcctggtcaaggctacttccgtatctct

SEQ ID NO: 534221 - DNA, 499 bp, Homo sapiens
  misc_feature: HEFZJCU01BDZUD.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccaggggacagggccatcagaacagcctacatggagctgaacagactgacatctgacgacacggcccgtttattattgtgtgagagaggtacccgagtgaaccgtcc

SEQ ID NO: 534222 - DNA, 535 bp, Homo sapiens
  misc_feature: HEFZJCU01BSVFJ.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaaggcccatcggtcttccccttggcacccgtccctccacgagcacctcctgggggcacagcggccctcgggctgcctc

SEQ ID NO: 534223 - DNA, 529 bp, Homo sapiens
  misc_feature: HEFZJCU01B0FZS.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataaccgttcgcctggttattaccttgacacttggggccagggaaccctggtcaccgtctcctcagcctccaccaagggcccatcggtcttccccctggccgccctcgctccaggagcacctccgacgagcacagcggcccgtcgggctgcctggtcaggacacttcacg

SEQ ID NO: 534224 - DNA, 519 bp, Homo sapiens
  misc_feature: HEFZJCU01BITK7.47.56.F01.1.454.heavy.3.raw
agctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagcctggggggtccctgagactctcctgtgcagcctctggattcaccttcagtagttactggatgcactgggtccgccaagctccagggaagggactggtgtgggtctcacgtattaatcctgatggaagtcgcacaaactacgcggactccgtgagggaccgattcaccatctccagagacaacgccaagaacacgctgtatctgcaaatgacacagtctgagagccgacgatggcggctgtattattttctgttgcaagagatacaatggtggggacccgtacttttaatttcagggttcgtc

SEQ ID NO: 534225 - DNA, 515 bp, Homo sapiens
  misc_feature: HEFZJCU01CLKM7.40.12.B01.1.454.heavy.3.raw
tctagcgactcacgaccggtgctcgatttagtagtgtagattccgcgggctgggagaggagccccagccctgagattcccaggtgtttccattcagtgatcagcactgaacacagaggactcaccatggagttgggactgagctggattttccttttggctattttaaaaggtgtccagtgtgaagtgcaactggtggagtctgggggagacttggtacagcctggcaggtccctgagactctcctgtacagcctctggattcacctttggtgattatgccatgcactgggtccggcaagctccagggaagggcctggagtgggtctcaggtatgaattggaacagtgctagtatcggctatgcggactctgtgaggggccggttcaccatctccagagacagcgccaagagttccctgtacctgcaaatgaacagtctgagaattgaggacacggccttgtattattgtgcggaaggggactagtgggttcgggggaggggcccgttccactat

SEQ ID NO: 534226 - DNA, 511 bp, Homo sapiens
  misc_feature: HEFZJCU01CKBQP.48.81.H04.1.454.heavy.3.raw
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggccccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagttatcatctactactttgaattcg

SEQ ID NO: 534227 - DNA, 537 bp, Homo sapiens
  misc_feature: HEFZJCU01EX6QT.17.28.C06.1.454.heavy.3.raw
  modified_base (523)..(523): a, c, t, g, unknown or other
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggaccgtgtattactgtgcgagatgtaggaaaaagtaataggctgtgtttattggggccaggggancccgtggtcaccgt

SEQ ID NO: 534228 - DNA, 493 bp, Homo sapiens
  misc_feature: HEFZJCU01DX3XD.13.86.H09.1.454.heavy.3.raw
tcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtgatatcgacaaagttactaac

SEQ ID NO: 534229 - DNA, 494 bp, Homo sapiens
  misc_feature: HEFZJCU01B40WF.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacattgatggaactaatagacgctatgccgactccgtgaagggccgattcaccatcctccagagacaattccaagaacacgcagtatctgcaaatgaacagcctgagagctgagacgacgctgtgtattactgtgggagagatggaggtcgatattgtt

SEQ ID NO: 534230 - DNA, 529 bp, Homo sapiens
  misc_feature: HEFZJCU01DMIF5.49.28.C06.1.454.heavy.3.raw
  modified_base (344)..(344): a, c, t, g, unknown or other
agtcgagagacacgaccggtgctcgatttagagctcacgtattgggtttgggagaggagcccagcactgggattccgaggtgtttccattcagtgatctgcactgaacacagaggactcgccatggagtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggngtttacacatactacgcagactccgtgaagggcagattcaccatctccagagacggtttcaagaacacactctatcttcaaatgaacagcctgagagccgaggacacggactgtgtattactgtgcgagagacgtccccgggtagtacgtcagtgtctgggtacatatttactcggggccgtaac

SEQ ID NO: 534231 - DNA, 532 bp, Homo sapiens
  misc_feature: HEFZJCU01CV6KN.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctcctgaaactgagctctgtgaccgccgcagacacggctgtttattactgttcgagacatgccgaccgagagcattatcgggcaggttacggttttgattatttcgggggccaaggggacaaggggtccaccgtctccgcgacgcctcccaaccg

SEQ ID NO: 534232 - DNA, 525 bp, Homo sapiens
  misc_feature: HEFZJCU01D3KJB.11.67.G01.1.454.heavy.3.raw
cgagagataccacgaccggtgctcgatttagagtatacatattgggggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccaacggtcatcgtctcctcagcctccaccaacgggcccatcggtcttccccctcggccaccctccctccaagagcacctcctggggcacagccggcccgtcgggctcgcctggtcaacggacttaccg

SEQ ID NO: 534233 - DNA, 499 bp, Homo sapiens
  misc_feature: HEFZJCU01BL03P.40.81.H04.1.454.heavy.3.raw
tctagcgactcacgaccggtgctcgatttagtagtgtagattcgcgggggccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgtaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagtcggactgacctctgacgacacggccatgtatttactgtggaaggaagaacggttggtgggctacggccgggg

SEQ ID NO: 534234 - DNA, 520 bp, Homo sapiens
  misc_feature: HEFZJCU01COZS8.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggtttcctcgttgctcttttaagaggtgtccagtgtcaagtgcaactggtggagtctgggggaggcgtggtccagcctgggaggtcacagagactctcctgtgcagcctctggggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccaggcgggagttccaagtacgttccg

SEQ ID NO: 534235 - DNA, 536 bp, Homo sapiens
  misc_feature: HEFZJCU01BM7FA.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgtctggggccaggggaccctggtcatcgtctccccagccctccaccaacgggcccacgtcggtcctttccccctcggccgcccgtcg

SEQ ID NO: 534236 - DNA, 495 bp, Homo sapiens
  misc_feature: HEFZJCU01EEV8G.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggtcctttgacttc

SEQ ID NO: 534237 - DNA, 530 bp, Homo sapiens
  misc_feature: HEFZJCU01CPVWC.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacattactccgcagactccgtagaggggccgattcaccatctccagagacaattcccaagtaacacgctgtttcttcaaatgaacagcctgagagccgatgacacggccgtgtattacctgtgcgagagagtggggcccacggaacgttacgtaacgctatggacgtcgtggggccaaggggacccg

SEQ ID NO: 534238 - DNA, 519 bp, Homo sapiens
  misc_feature: HEFZJCU01C0XSJ.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtatcaactggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccaacgatcccgggtagagcccgtacggccgagccggccttttcggactttccgtc

SEQ ID NO: 534239 - DNA, 511 bp, Homo sapiens
  misc_feature: HEFZJCU01BG2OM.7.28.C06.1.454.heavy.3.raw
  modified_base (476)..(476): a, c, t, g, unknown or other
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacgataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttnatctagatacgtgggccagggaccctggtcgtccg

SEQ ID NO: 534240 - DNA, 501 bp, Homo sapiens
  misc_feature: HEFZJCU01BVVVP.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggtccggttctccatctccagagacaattccaagaacacgctgtatctgcaattgaacagcctgagagccgaggacgacggccgtatattacctgtgacgaaagagttttaggggaatggacctgtac

SEQ ID NO: 534241 - DNA, 524 bp, Homo sapiens
  misc_feature: HEFZJCU01B77KS.48.5.A05.1.454.heavy.3.raw
agtatacatacacgaccggtgctcgatttagatagatagacaggggagagaggagcccagccctgggattttcaggtgttttcatttggtgatcaggactgaacagagagaactcaccatggagtttgggttgagctggctttttcttgtggctattttaaaaggtgtccagtgtgaggtgcagctgttggagtctgggggaggcttggtacagccgggggggtccctgagactctcctgtgcaacctctggattcacctttaggggctatgccatgaactgggtccgccaggttcctgggaaggggctggagtgggtctcgatctattagtgagactggtgatactacagactacgcagactccgtgaggggccggttcaccgtctccagagacaattccaagaacacgctatttctgcaaatgaacagcctgagagtcgacgacacggccgtatactactgtgcgagacagatgctgccgcctgttccgtgggccagggaacctggtcaccgtctcctcacg

SEQ ID NO: 534242 - DNA, 529 bp, Homo sapiens
  misc_feature: HEFZJCU01DRKO3.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactatacactagctccttttactacctcccttgacttctgggccagtcggaacccggtccg

SEQ ID NO: 534243 - DNA, 401 bp, Homo sapiens
  misc_feature: HEFZJCU01CWNN8.13.4.A04.1.454.heavy.3.raw
tcacgtactacacgaccggtgctcgatttagagtagtgatcagggtccgccaggctccagggaaggggctggagtgggtctcaactattagtgctagtggtgccaccacatactacgcagactccggtgaagggccgattcaccatctccagagacaattccaagaacacgctgtatctgcaaatgaacagcctgagagccgaggacacggccgtatattactgtgcgaaggaaatttacccctatacttttgactactggggccagggaaccctggtcaccgtctcctcagcctccaccaagggcccatcggtcttccccctggcaccctcctccaagagcacctctgggggcacagcggccctgggctgcctggtcaaggactacttccgtactagacg

SEQ ID NO: 534244 - DNA, 512 bp, Homo sapiens
  misc_feature: HEFZJCU01BB2IM.21.19.B08.1.454.heavy.3.raw
tcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccaggaaaggggctggagtggctctcacagattagtggtagtagtagtttcatatattacgcagactcagtgcagggccgattcaccatctccagagacaacgccaagaattccctgtatctgcaaatggacagcctgagagtcgaggacacgggctatgtattactgtggcgggtggcgtgggggcggggtatgacgtagcgtgggggccaac

SEQ ID NO: 534245 - DNA, 515 bp, Homo sapiens
  misc_feature: HEFZJCU01BJ6GL.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagaggccgacgacacggccatatattactgtgcgaaagcaccggcagttagtccacccgatactactttgactacgtggggaccg

SEQ ID NO: 534246 - DNA, 499 bp, Homo sapiens
  misc_feature: HEFZJCU01A6CKW.52.70.G04.1.454.heavy.3.raw
cgcagtacgacacgaccggtgctcgatttagtgtagtgtgaagggaaaggggacccaacaaccacatccctcctcagaagcccccagagcacaacgcctcaccatggactggacctggaggatcctctttttggtggcagcagccacaggtgcccactcccaggtccaaattgtgcagtctggggctgaggtgaagaagcctggggcctcagtgaaggtttcctgcaaggcttctggatacagtttcactaggtattcgatgcattggctgcgccaggcccccggacaaaggcctgagtggatgggaagtctcagtgatggcaaaggtgacaaaaagtattcacagaagttccagggcagagtcaccattaccagcgacgcatccgcgaacacagcctatatggaactcagcagcctgagatcgtgaagacatggctgtctattactgtgcgagggtcggcacgctgacaacctcttacttctattcctacgctagtcg

SEQ ID NO: 534247 - DNA, 491 bp, Homo sapiens
  misc_feature: HEFZJCU01EUU6S.19.1.A01.1.454.heavy.3.raw
  modified_base (456)..(456): a, c, t, g, unknown or other
tactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggcttgagtggatgggaggaagcatccctttctttgatactccagactacgcacagaagttccagggcagagtcacgattaccgcggacgaatccacgagcacagtctatatggaattgaccagcctgacatcaggaggacacggccgtctatttttgtgcgacagaaaganattcatactcagggcgggcactatggcagcagctg

SEQ ID NO: 534248 - DNA, 502 bp, Homo sapiens
  misc_feature: HEFZJCU01C3JV3.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatacttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttctc

SEQ ID NO: 534249 - DNA, 366 bp, Homo sapiens
  misc_feature: HEFZJCU01C20EW.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggaccgtggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccaggccgctggaacaccgacctgagtggatgggatggggacgtaaccctaacacctggtcgtcacagtgtcttccaacccatccc

SEQ ID NO: 534250 - DNA, 545 bp, Homo sapiens
  misc_feature: HEFZJCU01CV9OZ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcacatctccagagacaattacaagaacaccctttatctgcaaatagacagcctgagaccagacgacacggctgtcttattattgcgcgagagagacacacgaacctactggaccaatactatgggggtcttgttctggggccgagggggaccctggtcatcgtcctccccgagccctccaccgaacgggcccaatccgggtccttcccccgtcggccgcccttcg

SEQ ID NO: 534251 - DNA, 513 bp, Homo sapiens
  misc_feature: HEFZJCU01BCVTO.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaagggaggggggaaccgaggcgggagttccaagtactcctttg

SEQ ID NO: 534252 - DNA, 513 bp, Homo sapiens
  misc_feature: HEFZJCU01EINMI.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaattggcgggctactacgagaacggattgggcgcctggggccaagggaccacggtcatcgtctccgcagcctccaccaagggcccatcggtcttccccctggcaccctcctccaagagcacctctgggggcacagcggccctgggctgcctggtcaaggactacttccgagtgcgtcgt

SEQ ID NO: 534253 - DNA, 508 bp, Homo sapiens
  misc_feature: HEFZJCU01EHYN1.17.25.C03.1.454.heavy.3.raw
  modified_base (480)..(480): a, c, t, g, unknown or other
cgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacgggccgtctattactgtgcgagagtcccacgatccggtgacncctacggcagccggcctttgacgttctc

SEQ ID NO: 534254 - DNA, 494 bp, Homo sapiens
  misc_feature: HEFZJCU01CGSQP.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaacgggaccacggtcatcgtctccgcagcctccaccaagggcccatccggtcttccccctggccaccctcctccaagagcacctctgggggcacagcggccctgggctgcctggtcaggactacttccgagtgcgtct

SEQ ID NO: 534255 - DNA, 430 bp, Homo sapiens; identical to SEQ ID NO: 471364
  misc_feature: HEFZJCU01EJ8MX.4.37.D04.1.454.heavy.3.raw

SEQ ID NO: 534256 - DNA, 513 bp, Homo sapiens; identical to SEQ ID NO: 447518
  misc_feature: HEFZJCU01CDWWY.19.67.G01.1.454.heavy.3.raw

SEQ ID NO: 534257 - DNA, 532 bp, Homo sapiens
  misc_feature: HEFZJCU01COPNS.4.35.D02.1.454.heavy.3.raw
agcactgtagcacgaccggtgctcgatttagcacacgatagttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcggggctattatggttcgggagatcccagtggttttgatatagtggggccagggggacaggcggtcgaccggtctccttcagtccc

SEQ ID NO: 534258 - DNA, 504 bp, Homo sapiens
  misc_feature: HEFZJCU01AOR31.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctcgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatgaccctgtggacacagcccacatattactgtgcacagagatacgggcaagcacgtgggtttggggctacgtggggccagggaaccctgggtcaccggtctcctcacgcctccaaccg

SEQ ID NO: 534259 - DNA, 487 bp, Homo sapiens
  misc_feature: HEFZJCU01BIP8V.10.85.H08.1.454.heavy.3.raw
  modified_base (425)..(425): a, c, t, g, unknown or other
catagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctcctggggccaggggaaccctggtcaccgtctcatcagcctccaccaagggcccatcggtcttcccctggcgccctgctccngagcacctccgagagcacagcggccctgggctgcctggtcaaggactactcccactactatg

SEQ ID NO: 534260 - DNA, 528 bp, Homo sapiens
  misc_feature: HEFZJCU01DHTT7.7.78.H01.1.454.heavy.3.raw
  modified_base (466)..(466): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaccttcaacctgacgacactgccgtttattttgtacgagagcgtcgtctntcagtggaattgactacgtggggccgagggaaccctggtctaccgtctcctcagcctccacc

SEQ ID NO: 534261 - DNA, 504 bp, Homo sapiens
  misc_feature: HEFZJCU01CVGQ4.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggctacttcctatgtaatct

SEQ ID NO: 534262 - DNA, 504 bp, Homo sapiens
  misc_feature: HEFZJCU01BSMN4.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaaccacagtctacatgcaactgacgagcctgagagctgacgacacggccgtctattactgtgcgagaatgttttctgtcatcgtactaatttgataggctctatggtacgtggacgttc

SEQ ID NO: 534263 - DNA, 487 bp, Homo sapiens
  misc_feature: HEFZJCU01A9LXC.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggaataatgggggctcaaaccaaatttttcactactggggccagggatccctggtcgccggtcggctcagcctccaccaaggcccatcggtcttcccctggcgccctgctccaggagcacctccgagacgcacagcggccctggggctgccgtggtcaaggactacttcctacgtgagcgt

SEQ ID NO: 534264 - DNA, 495 bp, Homo sapiens
  misc_feature: HEFZJCU01CFGX5.12.75.G09.1.454.heavy.3.raw
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgtacagaaattccaggacagagtcacgattaccgcggacgaatccacgaccacagcctacatagagctgcgcagcctgagatctgaagacacggccatttattactgtgcgagtagatgcgacgggccctccgacactcggtttattttccg

SEQ ID NO: 534265 - DNA, 516 bp, Homo sapiens
  misc_feature: HEFZJCU01A3J2G.48.27.C05.1.454.heavy.3.raw
agtatacatacacgaccggtgctcgatttagacgcgatcgaagggtttggggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcgggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccggtcgggaggggatagttacttt

SEQ ID NO: 534266 - DNA, 522 bp, Homo sapiens
  misc_feature: HEFZJCU01DWIP0.52.38.D05.1.454.heavy.3.raw
cgcagtacgacacgaccggtgctcgatttagtatctgatagttgggtttggggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctgggccgtggcacctggtcactgtcttctcagcctccaccaagggcccatcggtccttccccctcggccaccctccctccaagagcacctcgtgggggcacgagccggccctgggctgcctggtcaggactactcctatacg

SEQ ID NO: 534267 - DNA, 555 bp, Homo sapiens
  misc_feature: HEFZJCU01EQ501.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatcttgcaattaaccagcctgagagtcgaggacaccggccctttattactgtgcgaaggatcgccctataatggtgggttggagtcggggtagtttcggtttcctgggggccaggggaaccctggtcctacccgg

SEQ ID NO: 534268 - DNA, 506 bp, Homo sapiens
  misc_feature: HEFZJCU01CLW05.17.10.A10.1.454.heavy.3.raw
  modified_base (443)..(443): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattacngtgcgagaatgttttctgtcatcgtacaatttgattaggctcgtactaggactggacttcgtc

SEQ ID NO: 534269 - DNA, 522 bp, Homo sapiens
  misc_feature: HEFZJCU01DMGR5.5.33.C11.1.454.heavy.3.raw
atcagacacgcacgaccggtgctcgatttagagtgagctcgttgggtttgggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatccctcgttttacgatttttggactggcccgttggggtactcctacggtttggacgtctggggccaagggaccacggtcaccgtctcctcagcctccaccaagggcccatcggtcttcccctggcaccctcctccaagagcacctctgggggcacagcggccctgggctgcctggtcaaggctacttcccgtgtctgat

SEQ ID NO: 534270 - DNA, 526 bp, Homo sapiens
  misc_feature: HEFZJCU01CTZTX.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaacgtacaatccgtccctcaagagtcgagtcatcatatccgtagacaggtccaaggaacgaattctccctgaaagtgagttctgtgaccgtcgcagacacggctgtctattattgtgcgagacggcaaatatggttcagggattcgactctggggccagggaaccctggttaccaccgtctccctcacgcctccaccaaggg

SEQ ID NO: 534271 - DNA, 494 bp, Homo sapiens
  misc_feature: HEFZJCU01EB71E.48.23.C01.1.454.heavy.3.raw
  modified_base (477)..(477): a, c, t, g, unknown or other
agtatacatacacgaccggtgctcgatttagtacacgtgattagggattggggacccaacaaccacatccctcctcagaagcccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaagacacggcagtatattactgtgcgagaggcggatattgtcgtacgaggngactgctacagtcaaat

SEQ ID NO: 534272 - DNA, 548 bp, Homo sapiens
  misc_feature: HEFZJCU01BNTF1.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtgatccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggtcttgttcttgggggccgacgggggacccgttggtcgactcgtcctccccacgtccctcccaacccaagggccccatcggtcctttccccctggccgtcccc

SEQ ID NO: 534273 - DNA, 512 bp, Homo sapiens
  misc_feature: HEFZJCU01DKJQM.51.65.F10.1.454.heavy.3.raw
cgatcgtatacacgaccggtgctcgatttagctacgctctaaggggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcaggggtcaccatgaccagggacaagtccaccaacacagcctacatggaactaagggggactgacatctgacgacacggccatgtattattgtgcgagagaaatgttaggtactgctttgggtccctgggggcccgggaacccggggtc

SEQ ID NO: 534274 - DNA, 379 bp, Homo sapiens; identical to SEQ ID NO: 444450
  misc_feature: HEFZJCU01EZGV7.47.77.G11.1.454.heavy.3.raw

SEQ ID NO: 534275 - DNA, 407 bp, Homo sapiens
  misc_feature: HEFZJCU01CGJI5.49.9.A09.1.454.heavy.3.raw
agtcgagagacacgaccggtgctcgatttagcgagacgcgcagggcacgaccggtgctcgatttagctgtgcgtcgaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaggactacttcctctctcgact

SEQ ID NO: 534276 - DNA, 321 bp, Homo sapiens
  misc_feature: HEFZJCU01CTHPC.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataacagtctgagacttgaggacacggctgtctattactgtgcgaag

SEQ ID NO: 534277 - DNA, 595 bp, Homo sapiens
  misc_feature: HEFZJCU01A2QFA.53.78.H01.1.454.heavy.3.raw
cgcgtatacacacgaccggtgctcgatttagtgtgagtagtttgggtttgggctgagctgggttttcctcgttgctcttttaagaggtgtccagtgtcacgtgcagctggtgcagtctggggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtctttactatgaactcgacgtaggttgggtttacggttaccggttacccgtacccgggtccgggtaccggaaaccgggtaacccggttacggtcccgtaccggttcccttcccgtacgaccgttcccttacccgaaccggacccgggaaccctacggttccggtttcccccttccccggtccggcccgtaccgtccg

SEQ ID NO: 534278 - DNA, 527 bp, Homo sapiens
  misc_feature: HEFZJCU01AYS7H.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcgttatcttgcagataaccaaccttcaacctgacgacactgccgtttatttttgtacgagagcgtcgtctgtcagtggaattgactactgggcaggaccctggtcaccgtctccgtcacgcctccacc

SEQ ID NO: 534279 - DNA, 491 bp, Homo sapiens
  misc_feature: HEFZJCU01BEE8O.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagacgcacagcggccctgggctgcctggtcaaggactacttccgtatctctc

SEQ ID NO: 534280 - DNA, 544 bp, Homo sapiens
  misc_feature: HEFZJCU01B9VKH.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaaccaccaagaacacactatatctgcagattgacagtctgacgacccgaggaccacggctggtgtattactggtgcaagccagttcgtggaaaactagtttatgggttggggggagtttggggtttttttttacgttacgttacgggt

SEQ ID NO: 534281 - DNA, 505 bp, Homo sapiens
  misc_feature: HEFZJCU01EVWTI.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtggggtggcgattatatcacatgatggaactaatagacgctatgccgactccgtgaagggccgattcaccatctccagagaacaattccaagaaacacgacagtaatctgcaaatgaaacagcctgagagctggaggacacggctggtgtattacgtgtgggagaggagtggaggtcgatagttgta

SEQ ID NO: 534282 - DNA, 518 bp, Homo sapiens
  misc_feature: HEFZJCU01D6CY0.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgccggccgtatattactgtgcgagagtacgtagcggctcgtcctttgacttacgtggggcctgggaactctggtcaccgtctcc

SEQ ID NO: 534283 - DNA, 519 bp, Homo sapiens
  misc_feature: HEFZJCU01DQGO2.12.25.C03.1.454.heavy.3.raw
  modified_base (489)..(489): a, c, t, g, unknown or other
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaaggggcttgagtggatggggtggatcaacgtacagactggtggcacaggactatgcacaggggctccagggcagactcaccatgaccacagacacatcagcgaacacagtcaacatggagttgcggagcctgcgatctgacgacgcggccgtatattactgtagcgagagtacgtagcggctcgtacctttgactcnggggcctggggaactgtgtcaccgtctccg

SEQ ID NO: 534284 - DNA, 508 bp, Homo sapiens
  misc_feature: HEFZJCU01DRW6H.14.23.C01.1.454.heavy.3.raw
cgtctagtaccacgaccggtgctcgatttagtacacgtgattagggattggggccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcactttcagcacctatgctatcaactgggtgcgacaggcccctggacaagggcttgagtggatgggaggaatcatccctatgtttggtacaactaactacacacagaagttccagggcagagtcacgattaccgcggacgaatccacgagcacagcctacatggagctgagcagcctgagatcctgacacacggccgtgtattactgtgcgagggcccttcggtttctcagtgccttggtttgtagaacgtgggccgacgggaactcgtggtcaccgtctcctcagcctccaccg

SEQ ID NO: 534285 - DNA, 505 bp, Homo sapiens
  misc_feature: HEFZJCU01AV6HL.10.71.G05.1.454.heavy.3.raw
catagtagtgcacgaccggtgctcgatttagtgtcgtcgcaagagagaggggggggagaggagcccagcactagaagtcggcggtgcctccattcggtgatcagcactgaacacagaggactcaccatggagtttggggctgagctgggtttttcctcgttgctcttttaagagatgtccagtgtcagatgcagatggtggagtctggggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctggagagccgaggacacggggtgtttattactgtgggagaaatcctagtggcatcacctggtt

SEQ ID NO: 534286 - DNA, 518 bp, Homo sapiens
  misc_feature: HEFZJCU01DMEXM.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccagggcccatcggtctcccctgcgcctgctcagagcacctcgagagcacacgcggccctgggctgcctggtcaggactacgttcc

SEQ ID NO: 534287 - DNA, 510 bp, Homo sapiens
  misc_feature: HEFZJCU01BF6R2.7.28.C06.1.454.heavy.3.raw
  modified_base (477)..(477): a, c, t, g, unknown or other
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgagggccgattcatcatctccagagacaacgccgacaactcactgtctctgctgatgagcagcctgagagccgagacacggctatctattactgtgcgaaactctcattccgttcatcngaatactggggtccagggaaccctggtcgtccg

SEQ ID NO: 534288 - DNA, 522 bp, Homo sapiens
  misc_feature: HEFZJCU01CURUA.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagcccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggaagggctggagtgggtggccaacatagagtacgatggaagtgagaaaactatgtggactccgtggaagggccgagttcaccatctccagagacaacgacaagaatttagtgtatctgcaaatgagcagcctgagacgccgaggacacggctgtgtattatgtgcgag

SEQ ID NO: 534289 - DNA, 510 bp, Homo sapiens
  misc_feature: HEFZJCU01EX7TJ.11.27.C05.1.454.heavy.3.raw
cgagagataccacgaccggtgctcgatttagacgcgatcgaagggtttggggggaggagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctgggagtgggtctcatccattagtagtaatagtgcctacagatactacgcagactcactgaagggccgactcaccatctccagagacaacgccaagaactcactgtatctgcaaatgaaacagcctgagagccgaaggacaccggctagtgtattactgtgtcgaggtaggagtctatttatctggaaccccg

SEQ ID NO: 534290 - DNA, 526 bp, Homo sapiens
  misc_feature: HEFZJCU01DHGN2.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctgggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagccctcagatctgacgacacggccgtgtatttctgtgcgagtcttgatagtagtggttatcctgaatactggggccagggaaccctgatgaccgtctcctcagcctccaccaagggcccatcggtcttcccctggccgccctgctccaggacgcacctccgagagcacacgcggcctc

SEQ ID NO: 534291 - DNA, 506 bp, Homo sapiens
  misc_feature: HEFZJCU01CW14B.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatctccagagacaagtggcaacaactcactgtatctggaatcaacagcctgagagtcgaggacgacggctgtatattatttgtgcgagacgcccccgtacggtcggtaccg

SEQ ID NO: 534292 - DNA, 501 bp, Homo sapiens
  misc_feature: HEFZJCU01EJI97.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtgggtgggtcagcggctttgacggtaaggcacagtatgcaccgaagatgaaggcagagtcacgattaccacggacacccccacgaacacagtctacatgcaactgacgagcctgagagctgacgacacggccgtctattactgtgcgagaatgttttctgtcattcgtacaatttgataggctctatggactggacttcgtc

SEQ ID NO: 534293 - DNA, 492 bp, Homo sapiens
  misc_feature: HEFZJCU01CLDZR.52.25.C03.1.454.heavy.3.raw
cgcagtacgacacgaccggtgctcgatttagtagtgtagatttgggtttgggggtctgggagaggagcccagcactagaagtcggcggtgtttccattcggtgatcagcactgaccacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcaatagctatggcatgcactgggtccgccgaggctccaggcaaggggctgaggtgggtggccagtatgtcatatggtggacttaatgcatactatgcagactccgtgaagggccgattcatcatctccagagacaattccaagaacacgctgtatctgcaaatgaacagcctgagagctggaggacgaacggctcgtgtattactgtgcgaaagagtaa

SEQ ID NO: 534294 - DNA, 485 bp, Homo sapiens
  misc_feature: HEFZJCU01AG5RA.48.71.G05.1.454.heavy.3.raw
agtatacatacacgaccggtgctcgatttagtgtcgtcgcaagagagagggggatcacataacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcacctttatggcggacgaatcctcgagcacagtctatatggatctggccagcctgaagtctgaagacgacgggcatatatttctgtgcgacagatggtcgtggattctcgtctg

SEQ ID NO: 534295 - DNA, 523 bp, Homo sapiens
  misc_feature: HEFZJCU01DUE4O.49.59.F04.1.454.heavy.3.raw
agtcgagagacacgaccggtgctcgatttagtacacacacttagggattggggatcacataacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactatttcatggaactgagcagcctcagatccgaggacacggtccgtttactacttgtgcggagcgactccgacttcccgtcggtttcgaggatgactacgtcgggggaccacggggaaccctc

SEQ ID NO: 534296 - DNA, 516 bp, Homo sapiens
  misc_feature: HEFZJCU01BV5PI.10.59.F04.1.454.heavy.3.raw
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtacttattgtgcgagacgaccccgctgaagattcctcaatgtactttgaccactgggggccagggagccctggtcaccgtctcctcacg

SEQ ID NO: 534297 - DNA, 498 bp, Homo sapiens
  misc_feature: HEFZJCU01CDE6Q.22.78.H01.1.454.heavy.3.raw
acatacgcgtcacgaccggtgctcgatttagtgtgagtagtttgggtttggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctatttctgtgtcaaagccagcgggcggatctacgatcctaacggctattactacggatttgacacctggggccagggaaccctggtcaccgtctcctcagcctccaccaagggcccatcggtcttccccctggcaccctcctccaagagcacctctgggggcacagcgcccgtgggctgcctggtcaaggactacttccagacgtaatca

SEQ ID NO: 534298 - DNA, 493 bp, Homo sapiens
  misc_feature: HEFZJCU01D2K02.48.71.G05.1.454.heavy.3.raw
agtatacatacacgaccggtgctcgatttagtgtcgtcgcaagagagaggggggcatcacataacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactggtgcgacaggtccctggacaaggacttgtgtggatggggggattcatccctatgtttaagagaatcaggcgtgctgagaagttcgaggacagagtcacctttatggcggacggaatcctcgagcacagtctatatggatctggccagcctgaagtctgaagacgacgggcatatatttctgttgcgacagatggtcgtggattctcgtctgcttat

SEQ ID NO: 534299 - DNA, 498 bp, Homo sapiens
  misc_feature: HEFZJCU01B0W12.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtgctacgagtactggtacttcgatctctgggccgtggcaccctgctgactgtctcctcagcctccaccagggcccatccggtcttccccgtggccgccctgcctccaggagcacctccgagacgcacagcggccctgggctgcctggtcaaggactac

SEQ ID NO: 534300 - DNA, 507 bp, Homo sapiens
  misc_feature: HEFZJCU01CPK0M.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgaggtggatggggtggatcaaccctaccagaggtggcacaaagtatcgacagaactttcagggcagggtcaccatgacctgggacgcgtccatcagcacagtctacatggatctgagcggactgacctacgtgacgacgacggccatgtattactgtaggagagacgttggtggcgtaccgcggggctgaccacgtggggaccg

SEQ ID NO: 534301 - DNA, 492 bp, Homo sapiens
  misc_feature: HEFZJCU01BDUS6.10.29.C07.1.454.heavy.3.raw
catagtagtgcacgaccggtgctcgatttagagtgctacgaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggaatccccttcagtacctatggcatgcactgggtccgccaggctccaggcaaggggctggagtgggtggcagccatatcgtatggatgtaactaataaatactatgcagactccgtagagggccgattcaccatctccagagacaatttcaagaacacgctgtttctgacaatgaacagcctgagagctgagacacggctgtgtattactgtgcgaagatatcgcggtgacc

SEQ ID NO: 534302 - DNA, 542 bp, Homo sapiens
  misc_feature: HEFZJCU01CTAFC.14.57.F02.1.454.heavy.3.raw
cgtctagtaccacgaccggtgctcgatttagctcgatatagttgggtttgggctgagttggctctttcttgtggttattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaaggccggttctccatctccagagacaattccaagaacactctatttcttcaaatggacagcctgaaagacgaagacacgggcgtgtatttttgtgtgaagatacgaagtctatgatacccaatttgggaggggcctttcatgtctggggccaagggacgctggtcaccgtctcttcagcctccaccaagggcccatcggtcttcccctcggcaccctcctccagagcacctcgtgggggcacgagcggcccg

SEQ ID NO: 534303 - DNA, 546 bp, Homo sapiens
  misc_feature: HEFZJCU01B8U4P.18.39.D06.1.454.heavy.3.raw
  modified_base (439)..(439): a, c, t, g, unknown or other
tacgagtatgcacgaccggtgctcgatttagtgacatctcgcagttctggggctgaggtgaagaaccctgggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggttagactactggggccagggcaccctggtcaccgtctcctcagcttccaccaagggcccatccggtcttccccnggtccgccctgctccaggtagctacctccgtgggggccacgagccgggcccttcggggcctcggcccttcgggtactaacgggtactaacctttccccaattacccg

SEQ ID NO: 534304 - DNA, 501 bp, Homo sapiens
  misc_feature: HEFZJCU01BZ9O2.11.19.B08.1.454.heavy.3.raw
cgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactggggtccgccaggctccagggaaggggctggagtgggtttcatacatttctagtaattctggtaccatacactatgcagtctctgtgaagggccgattcaccatctccagagacaacgccaggaactcactttatctgcaaatgaagcagcctgagagtcgaggacacgggtatttattactgtgcgagagatagtctgtctatgcttcgggagcta

SEQ ID NO: 534305 - DNA, 507 bp, Homo sapiens
  misc_feature: HEFZJCU01EAHTK.9.33.C11.1.454.heavy.3.raw
  modified_base (499)..(499): a, c, t, g, unknown or other
tgatacgtctcacgaccggtgctcgatttagagtgagctcgtgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctgggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgtcaatactatacagactccgtgaagggccgattcaccatctccagagacaattccaagaacacgatgtatctgcaatggacagcctaagagttgaggacacggctgtttattactgtacgaaggaggggggatacgagtggcagctcaagtactactttntacttctc

SEQ ID NO: 534306 - DNA, 508 bp, Homo sapiens
  misc_feature: HEFZJCU01CVZBZ.17.10.A10.1.454.heavy.3.raw
  modified_base (417)..(417): a, c, t, g, unknown or other
  modified_base (465)..(465): a, c, t, g, unknown or other
cgtagactagcacgaccggtgctcgatttagcgtcgatctcaggggacccaaaaaccacacccctccttgggagaatccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagngaaactgacgacacggccgtctaattctgcgcgagtaactggttttcngttcatcgtacaatttgataggctctatggactggacttcgtc

SEQ ID NO: 534307 - DNA, 554 bp, Homo sapiens
  misc_feature: HEFZJCU01DDJ61.17.28.C06.1.454.heavy.3.raw
  modified_base (535)..(535): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtagccgagatggaggaaaaagtaagtggacttggtgttttagttgggggccaggggacnccccgtagggtcctacccg

SEQ ID NO: 534308 - DNA, 532 bp, Homo sapiens
  misc_feature: HEFZJCU01EL3BK.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgttttattactgttcgagacatgccgaccgagagacattatcggtcagttacggttttgtattaagttttgggggtccgtaaggggacaacggggtacgacccgttccgtccgcc

SEQ ID NO: 534309 - DNA, 457 bp, Homo sapiens
  misc_feature: HEFZJCU01CRZ63.12.40.D07.1.454.heavy.3.raw
  modified_base (443)..(443): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacggactcggcctgtgttgcctctggatttcccttcaatttctattccatgcactgggtccgccaggctccaggcaaggggctcgagtgggtggcacttattgcacatgatggcgtcaacaaattctacgcaaattccgtgaggggccgagtttcacccatcctaccaggtacgacctaattacaaggaaccaacccttttatctgcaaatagaacagcctagacgtaccaagacgacacggctcgtctattattcgcgcggagagagaacncacggaacctaact

SEQ ID NO: 534310 - DNA, 376 bp, Homo sapiens; identical to SEQ ID NO: 479904
  misc_feature: HEFZJCU01AWF33.40.86.H09.1.454.heavy.3.raw

SEQ ID NO: 534311 - DNA, 527 bp, Homo sapiens
  misc_feature: HEFZJCU01A8GOP.8.34.D01.1.454.heavy.3.raw
  modified_base (501)..(501): a, c, t, g, unknown or other
ctcgcgtgtccacgaccggtgctcgatttagatcgtctgtgttgggtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgagttcaccatctccagagacaattccaggaacacaatgtatttggagctgaacagcctaagtcctgaggacacgggcgtatactactgtacgaaggagggggaaccagcggagttccaagtactctttgacgtctggggccagggtaccctggtcaccgtctcctcagctccaccaagggcccatcggtctcccctggcgcccngctccaggagcacctcccgagagcga

SEQ ID NO: 534312 - DNA, 497 bp, Homo sapiens
  misc_feature: HEFZJCU01BJQTF.11.72.G06.1.454.heavy.3.raw
  modified_base (453)..(453): a, c, t, g, unknown or other
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccaggcagagtcaccctgaccacagagacatccacgaccacagtctacatggagctgtggagcctgagacctgacgacacggcccgtctattactgtncgaggccctatcctacagtgaccactccacgctggttcgacctc

SEQ ID NO: 534313 - DNA, 536 bp, Homo sapiens
  misc_feature: HEFZJCU01BT2NK.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcacccatccttccagagacaattccaagaacacgctgtttcttcaaatgaacagcctgagagccgatgacacggccgtgtattactgtgcgagagagtgggggcccacgaacgttactaccggtctaacgtggtacgtcgtcgggggccaaggggacccg

SEQ ID NO: 534314 - DNA, 527 bp, Homo sapiens
  misc_feature: HEFZJCU01BLXIC.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtatactgtgcgagagatggggcccacgaacgttactacgctatggacgtctggggccaacgggaccacc

SEQ ID NO: 534315 - DNA, 507 bp, Homo sapiens
  misc_feature: HEFZJCU01A378U.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcgaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttccccctggcaccctcctccaagagcacctctgggggcacagcggccctgggctgcctggtcaaggactacttcctacgtcgtat

SEQ ID NO: 534316 - DNA, 504 bp, Homo sapiens
  misc_feature: HEFZJCU01DKF0O.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctggaggacacgggcttggtgtatttactgtgcgaaagatttctatagaggtgacgtac

SEQ ID NO: 534317 - DNA, 526 bp, Homo sapiens
  misc_feature: HEFZJCU01DHY61.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgttgcgagagatgggggcccacgaaccgttactacgctatggacgtcgtggggccaaggggaacccg

SEQ ID NO: 534318 - DNA, 514 bp, Homo sapiens
  misc_feature: HEFZJCU01COWL0.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagacacactgtctcttcaaatgaacagcctgagggccgaggacacggccgtctattattgtgtgaggagtttatggcgatggctgggtggacagatcactggggccac

SEQ ID NO: 534319 - DNA, 498 bp, Homo sapiens
  misc_feature: HEFZJCU01BDFSL.10.71.G05.1.454.heavy.3.raw
  modified_base (425)..(425): a, c, t, g, unknown or other
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtgcagatatacaatatgatgacagtaaaatatactatggagactccttcaagggccgattcaccatctccagagacaattccaagaacatggtntagtctgcaaatgaccagcctgagagccgaggacgacgggtagttttatacgtgtgggagaaatcctagtggc

SEQ ID NO: 534320 - DNA, 544 bp, Homo sapiens
  misc_feature: HEFZJCU01EFHRM.22.34.D01.1.454.heavy.3.raw
acatacgcgtcacgaccggtgctcgatttagatcgtctgtgttgggtttgggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaaccagttctccctgaaactgaggtctgtgaccgcagcggacacggccgtgtattactgtgcgagagagtccgggtccgatatctggccgttcgacccctggggccagggaaccctggtcaccgtctcctcacgcctccaccaagggcccatcggtcttcccctggcgccctgctccaggagcacctccgagagcacacgcggcccgtgggctgcctggtcaaggactacttccaccg

SEQ ID NO: 534321 - DNA, 482 bp, Homo sapiens
  misc_feature: HEFZJCU01C8NGP.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccaatgaccagggacacgcccatcagcacgtccatcagcacagcctacatggacctgaggcggcctgacatctgacgacacggccgtatatttctgtgcggaggg

SEQ ID NO: 534322 - DNA, 499 bp, Homo sapiens
  misc_feature: HEFZJCU01DGHT7.47.81.H04.1.454.heavy.3.raw
agctcacgtacacgaccggtgctcgatttagtagtgtagattcgcggggagctctgggagtggagccccagccttgggattcccaagagtttgtattcagtgatcaggactgaacacacaggactcaccatggagctggggctgagctgggttttccttgttgctatattagaaggtgtccagtgtgaggtgcagctggtggagtcggggggaggcctggtacagcctggggggtccctgagactctcctgtgcagcctctggattcatcttcagtgactacgacatgcactgggtccgccaagttgcaggagaacctctggaatgggtctccgttattgctactggtgtgccacagactatgcaggctccgtgaggggccgattcaccatctccagagaaaatggcaagaactcctgtatcttcaatgaacagcctgagaggccggggacgacggcggtagtattactgtgtaagagagctcgatggtacaggggact

SEQ ID NO: 534323 - DNA, 526 bp, Homo sapiens
  misc_feature: HEFZJCU01DZYDJ.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggctctacttctgtgcgaggagtaattactatacactgctccttttacacctccctgacttcgtgggccatcggaacccggtccg

SEQ ID NO: 534324 - DNA, 497 bp, Homo sapiens
  misc_feature: HEFZJCU01APXFS.49.85.H08.1.454.heavy.3.raw
agtcgagagacacgaccggtgctcgatttagtatcactcagtcgcgggggtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcagcttctctgggttctcactctccagtcctggagtgggtgtgggctggatccgtcagcccccaggaaaggccctggagtggcttgcactcatttattggaatgacgataagacctacagcccatctctgaagagcaggctcaccatcaccaaggacacctccaacaaccaggtggtccttacaatgaccaacatggaccctgtggacacagccacatattactgtgcacaccgtccccccgccgttacttattatgatgctagttgttattccaacgctgaatactccagcactcggggcagggca

SEQ ID NO: 534325 - DNA, 531 bp, Homo sapiens
  misc_feature: HEFZJCU01CDOAI.21.76.G10.1.454.heavy.3.raw
tcgtcgctcgcacgaccggtgctcgatttagtcactcatacaggggctgggagaggagcccagcactgggattccgaggtgtttccattcggtgatcggcactgaacacagaggactcaccatggagttttggctgagctgggttttccttgttactatttcaaaaggtgtccagtgtgaggtgcagctggtggagactggaggagacttgatccaacctggggggtccctgagactctcctgtgcggtctctgggttcaccgtcactactaactccatgagctgggtccgccaggctccagggaaggggctggagtgggtctcagttatttatagtggtggtggtgcagattacgcagactccgtgaagggccgattccaccatctccaggagacaattccatgaacacgctgtatcttcaaatgaacagcctgagagccgacgacacggaccgtctattactgtgcgacgggagtggacgggaggaggggcagtggatactttcgaccctacggtcgggggacgtaacc

SEQ ID NO: 534326 - DNA, 542 bp, Homo sapiens
  misc_feature: HEFZJCU01A5QZY.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagaccgaggacacggccatgtattactgtgtggggcatttacttgaccccgtgggggacccgggggtaaccctgggtccaccgtctcccccacccctccaacccg

SEQ ID NO: 534327 - DNA, 499 bp, Homo sapiens
  misc_feature: HEFZJCU01BJU5S.48.23.C01.1.454.heavy.3.raw
agtatacatacacgaccggtgctcgatttagtacacgtgattagggattggggacccaacaaccacatccctcctcagaagcccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgtgccaggcccccggacaaacgccttgagtggatggggtggctcaacgctggcgatggtcagacaaagtattcacagaagttccagggcagagtcaccatcaccagggacacgtccgcgagtagtgtcttcatggagctgcgcagtctgagatcggaagacacggcagtatattactgtgcgagaggcggatattgtcgtcgaggtgactgctacagtcaaaatcgtg

SEQ ID NO: 534328 - DNA, 512 bp, Homo sapiens
  misc_feature: HEFZJCU01EJRQ0.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacacggcccctggacaagggcttgagtggatgggatggatcagcgcttacaatggtaacacagactatgcacagaagttccaggacagagtcaccatgaccacagacacatccacgagcacagcctacatggagctgaggagcctggagatctgacgacacggccgtgtattactgtgcgagtagggttttagtgtatacttatttggtaggtgggtaggttaccgtggtcttacgtttttc

SEQ ID NO: 534329 - DNA, 511 bp, Homo sapiens
  misc_feature: HEFZJCU01C1VOB.12.1.A01.1.454.heavy.3.raw
  modified_base (441)..(441): a, c, t, g, unknown or other
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggagggctgaagtggattgggagtgtctattatagttgggatcgacctactacaacccgtccctcaagagtcgagtcaccatatccgtcgacacgtccaagaaccagttctccctgaagctgagctctgtgaccgccgcagacacggctgtgtattactgtgcgngacagccaagacagattttggagtggttactgttggactactttgactatggggccaggggaaccctggt

SEQ ID NO: 534330 - DNA, 505 bp, Homo sapiens
  misc_feature: HEFZJCU01E161K.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggtttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggcctgtgtatttacctgtgacgaaagatttactatagaggtgacgtac

SEQ ID NO: 534331 - DNA, 316 bp, Homo sapiens; identical to SEQ ID NO: 444479
  misc_feature: HEFZJCU01AMOQB.47.84.H07.1.454.heavy.3.raw

SEQ ID NO: 534332 - DNA, 505 bp, Homo sapiens
  misc_feature: HEFZJCU01CWF9E.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacgagcggcctgggctgctggtcaaggactacttccgagtagtaca

SEQ ID NO: 534333 - DNA, 520 bp, Homo sapiens; identical to SEQ ID NO: 446725
  misc_feature: HEFZJCU01BJIQW.12.86.H09.1.454.heavy.3.raw

SEQ ID NO: 534334 - DNA, 495 bp, Homo sapiens
  misc_feature: HEFZJCU01DC305.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatcgtgacgacacggccgtatattttctgcgcgagagacgtaagtgacgtggtattcgggggacac

SEQ ID NO: 534335 - DNA, 506 bp, Homo sapiens
  misc_feature: HEFZJCU01EHUU6.12.79.H02.1.454.heavy.3.raw
  modified_base (500)..(500): a, c, t, g, unknown or other
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaaatctcctgcaagtcttctggttacgcactcaccgccaatggtatcagctggctgcgacaggcccctggacaaggtcttgagtggatgtcatggatcagcactttcaatggagacacaaagtatggagagaacttccgagggcagagtcaccatgaccactgacagatcaacgaacatagcctacttggaactgaggggcctgaggtctgacgacacggccctctattattgtgcgagaattaattttcgttattgttctggtgtgtgtgtctaatgtttnacattc

SEQ ID NO: 534336 - DNA, 541 bp, Homo sapiens
  misc_feature: HEFZJCU01BQ1DQ.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagaccgtgtattactgtaccacatccctgaaagcgtcaacctactactacctacggtatcggacctctggggtaccg

SEQ ID NO: 534337 - DNA, 483 bp, Homo sapiens
  misc_feature: HEFZJCU01AGDUS.19.71.G05.1.454.heavy.3.raw
tactctcgtgcacgaccggtgctcgatttagtgtcgtcgcaagagagaggggggcagagtctgctgaattctggctgaccagggcaggtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactccgagacacgggtgtatattactgtggtaagacggccccatacg

SEQ ID NO: 534338 - DNA, 516 bp, Homo sapiens
  misc_feature: HEFZJCU01C1M50.52.71.G05.1.454.heavy.3.raw
  modified_base (480)..(480): a, c, t, g, unknown or other
cgcagtacgacacgaccggtgctcgatttagtgtcgtcgcaagagagaggggcacgaccggtgctcgatttagtgtcgtcgcaagagagaggggggctctgagagaggagcccagccctgggattttcaggtgttttcatttggtgatcaggactgaacagagagaaatcaccatggagtttgggctgagctggctttttcttgtggctattttaaaaggtggccaatgtgaggtgcagctggtggagtctgggggaggcttggtacagcccggggggtccctgagactctcctgtgcagcctctggattcagttttaccagctatgccatggcctgggtccgccaggctccagggaaggggctgggagtgggtctcaggtattagtggtagtgctatgaccacattctacgcagactccgtgaagggccggttcaccatttccagagacaattccaagagtaccctgtatctgcaaatnaacagcctgagagccgacgacacggccgtatactta

SEQ ID NO: 534339 - DNA, 499 bp, Homo sapiens
  misc_feature: HEFZJCU01BE4BO.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatctccagagacaatggcaacaactcactgtatctggaatcaacagcctgagagtcgaggacacggctgtatattattgtgcgagacgccccctacggtgtacg

SEQ ID NO: 534340 - DNA, 513 bp, Homo sapiens
  misc_feature: HEFZJCU01EQ0NA.49.81.H04.1.454.heavy.3.raw
  modified_base (464)..(464): a, c, t, g, unknown or other
  modified_base (481)..(481): a, c, t, g, unknown or other
  modified_base (498)..(498): a, c, t, g, unknown or other
agtcgagagacacgaccggtgctcgatttagtagtgtagattcgcggggtctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctggtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttnttactgtgcgaattaancacggaggacaagggtnacccccggtcacgtc

SEQ ID NO: 534341 - DNA, 487 bp, Homo sapiens
  misc_feature: HEFZJCU01E0JUJ.51.27.C05.1.454.heavy.3.raw
cgatcgtatacacgaccggtgctcgatttagacgcgatcgaagggtttggggctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagtaactatgcaatgcactgggtccgccaggctccaggcaaggggctggactgggtggcaggtatatcatatgatggaagcaataaatactacgcagactccgtgaagggccgattcaccatctccagagacagttccgatgacacagtctatctgcaaatgaacagcctgagagctgaggacacggcttctttttactgtgcgccaggaagcagt

SEQ ID NO: 534342 - DNA, 519 bp, Homo sapiens
  misc_feature: HEFZJCU01CUISJ.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacaccggccacctattatttgttgcgtcgaccatagtactaacgcctcaatttctagggggtccaggggaac

SEQ ID NO: 534343 - DNA, 514 bp, Homo sapiens
  misc_feature: HEFZJCU01D3M0R.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagcaggtggtatg

SEQ ID NO: 534344 - DNA, 466 bp, Homo sapiens
  misc_feature: HEFZJCU01BO5ZZ.16.78.H01.1.454.heavy.3.raw
tgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgaccccctggggccagggaatactggttcaccgtctcctcagcctccaccaagggcccatcggtcttcccctggcaccctcctccaagagcacctctgggggcacagcggccctgggctgcctggcaagactacttccgagtagtaca

SEQ ID NO: 534345 - DNA, 548 bp, Homo sapiens
  misc_feature: HEFZJCU01DALB5.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatagaacaatctgagagtcgacgatacggctgttctatcctagttgttggttttcgagttcgtcccgtttccggttcccggccggggtacctttcggtcggggggcccaacgggggtaaccccg

SEQ ID NO: 534346 - DNA, 390 bp, Homo sapiens
  misc_feature: HEFZJCU01DFMCC.16.70.G04.1.454.heavy.3.raw
tgtactactccacgaccggtgctcgatttagtgtagtgtgaagggaaggggctggagtggatcgggaatatctattatagtgggagcacctactacaacccgtccctcaagagtcgagtcgccatatccgtagacacgtccaagaaccacttctccctgaaactgagctctgtgaccgccgcagacacggctgtctattactggtgcgagacagagttacgacggtggttactccggtctctttgacaactggggccagggaaccctggtcaccgtctcctcagcctccaccaagggcccatcggtcttccccctggcaccctctccaagagcacctctggggcacagcggccctgggctgcctgtcaaggactacttccgagtagtaca

SEQ ID NO: 534347 - DNA, 510 bp, Homo sapiens
  misc_feature: HEFZJCU01CB3H5.53.49.E05.1.454.heavy.3.raw
cgcgtatacacacgaccggtgctcgatttagagcgactagcaacacacaaagggggctctgggagaggagcccagcactagaagtcggcggtgtttccattcggtgatcagcactgaacacagaggactcaccatggagtttgggctgaactgggttttcctcgttgctcttttaagaggtgtccagtgtcaggtacaactggtggagtctgggggaggcgtggtccagcctgggaggtccctgagactctcctgtgcagcctctggattccccttccatgtatttgccatgcattgggtccgccaggctccaggcaaggggctggagtgggtggcagttatatcctttgatggaagtaacaaatattatggagagtccatgaagggccgattcaccatctccagagacaattccaagaacatagtgtatctgcaaatgaacggcctgagaggtgacgacacggctgtgtattactgtgcgaagataatcccccgcctgagacttttggt

SEQ ID NO: 534348 - DNA, 511 bp, Homo sapiens
  misc_feature: HEFZJCU01A1PHW.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccgggtgagccctacggcacggcggccttttggacctttcgtc

SEQ ID NO: 534349 - DNA, 507 bp, Homo sapiens
  misc_feature: HEFZJCU01EFFDB.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaaggggctgggagtgcgtctcttttatcatatgatggaagtacaaaaattctatgcagactccgtgaagggccgattcaccgtctccgagggacaactccaagaacaccttatatctgcagatgaacagcctggagaggtgacgactcggctgtatacttctgtgcgacaaacatgattgtttggagtggatgtgtacttcta

SEQ ID NO: 534350 - DNA, 513 bp, Homo sapiens
  misc_feature: HEFZJCU01DWQCJ.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcatttagagccatggcttatgctgggacaacagaatacgccgcgtctgtgaaggcagattcatcatctcaagagatgattccaacggcatcgcctatctgcagatgaacagcctagaagaccggaggacacacgccgtctattactgtgttagggtagttttagtatttttggt

SEQ ID NO: 534351 - DNA, 529 bp, Homo sapiens
  misc_feature: HEFZJCU01A6PH4.48.86.H09.1.454.heavy.3.raw
agtatacatacacgaccggtgctcgatttagtgctatagacttgggtttggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttgtatgtcctttgattatggtggggcgaagggaacaagtggtcgaccgtctctttcacgccctccacccgaacgggtaccccg

SEQ ID NO: 534352 - DNA, 499 bp, Homo sapiens
  misc_feature: HEFZJCU01AO5KS.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccaggggacacggtccatcagcactgcctacatggagctgaccaggctgaaatttgaggacacggccatttattactgtgcaaggaacagcataatgactcgtccccggactttcg

SEQ ID NO: 534353 - DNA, 530 bp, Homo sapiens
  misc_feature: HEFZJCU01DO45D.48.33.C11.1.454.heavy.3.raw
  modified_base (502)..(502): a, c, t, g, unknown or other
agtatacatacacgaccggtgctcgatttagagtgagctcgttgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaccgggatagtactccaacttcggcttggacanctggggccaagggacctcggtcgtcccg

SEQ ID NO: 534354 - DNA, 509 bp, Homo sapiens
  misc_feature: HEFZJCU01D8JTK.8.33.C11.1.454.heavy.3.raw
  modified_base (317)..(317): a, c, t, g, unknown or other
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggnttggagtgggtggcagttgttcatctgagggcagtgttcaatggtatgctgacgccgtgaaggcgattcacatctcagagacactccaggaacacaatgtattgactgaacagcctaagtcctgaggacgacgggtgtatactactgtacgaggagggggacagcgggagtccagtactctttgacgtcgtc

SEQ ID NO: 534355 - DNA, 509 bp, Homo sapiens
  misc_feature: HEFZJCU01DPZI5.17.25.C03.1.454.heavy.3.raw
  modified_base (482)..(482): a, c, t, g, unknown or other
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccaataaacacagcctacatggagttgaggagcctgacatctgacgacacggccgtctattactgtgcgagagtcccacgatccggtagagccgtacggcngcggctttgactctggggccagggacg

SEQ ID NO: 534356 - DNA, 512 bp, Homo sapiens
  misc_feature: HEFZJCU01C82ZT.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctgtattactgtgcgaggcccctatcctacagtgaccaactccacgtcctggttcgaccctgtggggccaac

SEQ ID NO: 534357 - DNA, 511 bp, Homo sapiens
  misc_feature: HEFZJCU01DS3PQ.10.9.A09.1.454.heavy.3.raw
catagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccagcgggagtccaagtactcctttgacgtc

SEQ ID NO: 534358 - DNA, 474 bp, Homo sapiens
  misc_feature: HEFZJCU01C2BDB.48.49.E05.1.454.heavy.3.raw
agtatacatacacgaccggtgctcgatttagagcgactagcaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcgagggcagggtcaccatgaccaggggacacgtccatcagcacagcctacatggaattgagcaggctgacagtctgacgacaccggccgttgtatttagttgtgcgag

SEQ ID NO: 534359 - DNA, 468 bp, Homo sapiens
  misc_feature: HEFZJCU01BDER9.12.81.H04.1.454.heavy.3.raw
  modified_base (400)..(400): a, c, t, g, unknown or other
atacgacgtacacgaccggtgctcgatttagtagtgtagattcgcgggggggtccctgagactctcttgtgcaggctctggactcagcattagcaattatgccgtgagctgggtccgccaggttgcaggaaagggtctggaatgggtctcagtaattagtcatagtggtgatgtcacactctacgcggactccgtgaagggccggttcaccatctccagagacaattccaagaacacagtgtatttgcaaatgaacagcctgaaagccgatgacacggccatatattattgtgtgagagatgacgaaagcgaatatcattcgatcttgactactggggccagggaacccttgtcaccgtctcctcagcctccaccaaggcccatcggtcttcccctggcnccctgctccaggagcacctccgagagcacagcggcctggctgctggcaagactacttcctacgtcgta

SEQ ID NO: 534360 - DNA, 518 bp, Homo sapiens
  misc_feature: HEFZJCU01B23VW.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagacgcacctctgggggcacagcggcctggctgcctggtcaaggactacttccagacgtatca

SEQ ID NO: 534361 - DNA, 415 bp, Homo sapiens; identical to SEQ ID NO: 444794
  misc_feature: HEFZJCU01AIWFY.14.74.G08.1.454.heavy.3.raw

SEQ ID NO: 534362 - DNA, 516 bp, Homo sapiens
  misc_feature: HEFZJCU01C5BI7.40.31.C09.1.454.heavy.3.raw
tctagcgactcacgaccggtgctcgatttagacgtctcatcaaggaaggaaggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgcgcagacacggctgtctattactgtgcgaggccccgagcgcagtggcttttgtatgtcctttgtatatgtggggtccgaaggggacaaatggtcgaccgtctccttcagcctccaccaac

SEQ ID NO: 534363 - DNA, 510 bp, Homo sapiens
  misc_feature: HEFZJCU01B9CA5.4.67.G01.1.454.heavy.3.raw
  modified_base (484)..(484): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagcccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagancgtcggctggttccgcgggtccgggt

SEQ ID NO: 534364 - DNA, 537 bp, Homo sapiens
  misc_feature: HEFZJCU01CIKXN.17.28.C06.1.454.heavy.3.raw
  modified_base (371)..(371): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgnggactctgtgaagggccgtttcaccatctccagagacaacgccaagaattcactgtatctacaactgaacagcctgagagtcgcagacacggccgtgtattactgtgcgagatgtgaaaaagtataggctggtgtttagttggggccagggagccctggtctaccg

SEQ ID NO: 534365 - DNA, 501 bp, Homo sapiens
  misc_feature: HEFZJCU01DYPO4.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgcaggctccagggaaggggctggagtgggtctcatccattagtagtagtagtagttacatatactacgcagactcagtgaagggccgattcaccatctccagagacaacgccaagaactcactgtatctgcaaatgaacagcctgagagcccgaggacacggctgtgtattactgtgcgagtttgtttgggcggatagcagccggtacc

SEQ ID NO: 534366 - DNA, 534 bp, Homo sapiens
  misc_feature: HEFZJCU01BRBWC.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccaggacgacacggctgtctattattgcgcgagagagacacacgaacctactggccatactatgggggcttgttctggggccgaggggaccctggtccattccgtctccccagcctcccaccaagggcccatcggtccttcccctggccgccctcg

SEQ ID NO: 534367 - DNA, 516 bp, Homo sapiens
  misc_feature: HEFZJCU01D7LM6.40.81.H04.1.454.heavy.3.raw
tctagcgactcacgaccggtgctcgatttagtagtgtagattcgcggggaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtaggagagacggttggtggctaccggcggggctggaccacgtggggccacggggaaccctggtcaccgtctcccg

SEQ ID NO: 534368 - DNA, 521 bp, Homo sapiens
  misc_feature: HEFZJCU01BJ2R6.12.40.D07.1.454.heavy.3.raw
atacgacgtacacgaccggtgctcgatttagtgatagagcgtaacaacgagagggctcaccatggagtttgggctgagctggctttttcttgtggctattttaaaaggtgtccagtgtgaggtgcaactggtggagtctgggggaggcttggtacagccgggggggtccctgagactctcctgtgcaggctctggattcatctttaacaactatgccatgagctgggtccgccaggctccagggaaggggctggagtgggtctcagctattagtaatagtggtgatagcacatcctacgcagactccgtgaagggccgcttcaccatctccagagacaattccaagaacacgctgtatctccaaatgaacagtctcagagccgaggacacggccatatattactgtgcgaaagacacagccgcatttgggggagtcatcgtccttgagtactggggtccaggggaaccctggtcaccgtctcctcagcctccaccaagggcccatcggtcttccccctggt

SEQ ID NO: 534369 - DNA, 490 bp, Homo sapiens
  misc_feature: HEFZJCU01A0R6V.48.60.F05.1.454.heavy.3.raw
agtatacatacacgaccggtgctcgatttagtacgtcatcagggaaagggggcatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaagcctggggcctcgagtgaagatttcctgcaaggcatctgggatacatcttcaccacctacaatatacactgggtgcgacaggcccctcgacaagggcctgagtggatggggatgatcaaccctaggtatggcagcacaagccacgcagagaagttccagggcagagttatcatgaccagcgacacgtccacgagcacagtctacatgagtctgagcagcctgagatctgaagacacggccgtctattactgtgcgaggagggggggtggggtcccaaggtaccg

SEQ ID NO: 534370 - DNA, 532 bp, Homo sapiens
  misc_feature: HEFZJCU01DJYVR.17.28.C06.1.454.heavy.3.raw
  modified_base (369)..(369): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataagcaagatggaactgcgagttttacgnggactctgtgaagggccgtttcaccatctccagagacaacgccaagattcactgtatctacaactgaacagcctgagagtcgcagacacggccgtgtattactgtgcgagatgtggaaaagtaatggctgtgtttatggggccagggagcccgtggtctaccg

SEQ ID NO: 534371 - DNA, 505 bp, Homo sapiens
  misc_feature: HEFZJCU01C62D1.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaagggctggagtgggtctcatccattagtagtagtagtagttacatatactacgcagactcagtgaagggccgattcaccatctccagagacaacgccaagaacctcactgtatctgcaaatgaacagcctgagagccgaggacacggctgtgtattactgtgcgtagttttgttgggcgggatagcaggccgggtacc

SEQ ID NO: 534372 - DNA, 519 bp, Homo sapiens
  misc_feature: HEFZJCU01AKNJZ.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctatttgactactggggccaggggaactctggtcaccgtctccgcagcctccaccaacgggcccagtcc

SEQ ID NO: 534373 - DNA, 504 bp, Homo sapiens
  misc_feature: HEFZJCU01E0A2L.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaattgttttctgtcatcgtactaatttgataggctctatggactggacttcgtc

SEQ ID NO: 534374 - DNA, 481 bp, Homo sapiens
  misc_feature: HEFZJCU01CU746.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacggcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcactctggggcacagcggccctgggctgcctggtcaaggactacttcctagagacacg

SEQ ID NO: 534375 - DNA, 525 bp, Homo sapiens
  misc_feature: HEFZJCU01EBI6D.48.4.A04.1.454.heavy.3.raw
agtatacatacacgaccggtgctcgatttagagtagtgatcaggggatgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaactgaccgctgtgaccgccgcggacacggctgtgtattactgtgcgagacgaatgggcgggtggctacgacttgacttttggggccgagggaaacctggtcaccgtctccccagccttccaccaacgggcccactcggttcccg

SEQ ID NO: 534376 - DNA, 527 bp, Homo sapiens
  misc_feature: HEFZJCU01BOPHZ.10.59.F04.1.454.heavy.3.raw
  modified_base (345)..(345): a, c, t, g, unknown or other
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattggccttacacgattatagtgggactacccactacaacccgtccctcaggngtcgagtcaccatctcactagacacgtccaggaatcacctctccctgacggtgacctctgtgaccgccgcggacacggccgtgtattattgtgcgagagaccccgctgaagattccctcaatgtactttgaccctactgggggccaggggagcccgtggtccaccggtcttcccgtacacgg

SEQ ID NO: 534377 - DNA, 513 bp, Homo sapiens
  misc_feature: HEFZJCU01AWB4C.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagtttttggctgagctgggttttccttgttgctattttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacattattattctgactccgtgaacgggccggttcaccctctccagagacacttccaacaacatcttgtatcttcacatgcacaatctgagagtcgacgacacggccacctacttatttgtgcgacgacatgactcgctcaattctggggccaggggaccg

SEQ ID NO: 534378 - DNA, 535 bp, Homo sapiens
  misc_feature: HEFZJCU01EC5FN.16.27.C05.1.454.heavy.3.raw
  modified_base (524)..(524): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggtttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttattcatatgatggaactactcaaacactatccagactccggggagggccgattcaccgtctccagagacaattccaagaacagggtgtttctccaagtgattgatctgagaagtgaggacacggctagtttattactgtgcgcggtggctgaccgctcttgactacgtgggggccggggtacggccccggttnacgtcgtctcc

SEQ ID NO: 534379 - DNA, 511 bp, Homo sapiens
  misc_feature: HEFZJCU01CGJX5.48.71.G05.1.454.heavy.3.raw
agtatacatacacgaccggtgctcgatttagtgtcgtcgcaagagagaggggggatcacataacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagtagaatcaggcgtgctgagaagttcgaggacagagtcacctttatgggcggacggaatcctcgagcacagtctatatggatctggccagcctgaagtctgaagacacggggtcagtatattttctgtgcgaccagacgtggtcgtggtacgttctcgtcttgctttattgggaa

SEQ ID NO: 534380 - DNA, 508 bp, Homo sapiens
  misc_feature: HEFZJCU01E0Q76.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccagggcccatcc

SEQ ID NO: 534381 - DNA, 527 bp, Homo sapiens
  misc_feature: HEFZJCU01EXEFI.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttcgtggggccaggggaccctggtcgatccgtctccccagcctccaccaagggcccatcggtccttccccctggccg

SEQ ID NO: 534382 - DNA, 515 bp, Homo sapiens
  misc_feature: HEFZJCU01AVJ4P.2.16.B05.1.454.heavy.3.raw
  modified_base (486)..(486): a, c, t, g, unknown or other
  modified_base (505)..(505): a, c, t, g, unknown or other
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggttcctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagacccntacgtgggggaccccgggngccccgtcgt

SEQ ID NO: 534383 - DNA, 520 bp, Homo sapiens
  misc_feature: HEFZJCU01CEQW1.51.26.C04.1.454.heavy.3.raw
cgatcgtatacacgaccggtgctcgatttagtctagcgactttgggtttggggctgggagacgagcccagcactggaagtcgccggtgtttccattcggtgatcatcactgaacacagacatggagtttgggctgagctggggttttccctcgttgctcttttaagaggtgtccagtgtcaggtgcacctggtggagtctggggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgagacgagggctgtttattactgtgtgcgatcctacctcactggtacgggggtagttacttcctccgctaacggta

SEQ ID NO: 534384 - DNA, 506 bp, Homo sapiens; identical to SEQ ID NO: 473269
  misc_feature: HEFZJCU01CNQXL.17.25.C03.1.454.heavy.3.raw

SEQ ID NO: 534385 - DNA, 409 bp, Homo sapiens; identical to SEQ ID NO: 447146
  misc_feature: HEFZJCU01BRZBT.48.81.H04.1.454.heavy.3.raw

SEQ ID NO: 534386 - DNA, 549 bp, Homo sapiens
  misc_feature: HEFZJCU01EMQ6V.13.76.G10.1.454.heavy.3.raw
tcacgtactacacgaccggtgctcgatttagtcactcatacaggggggggagaggagcccagcactgggattccgaggtatttccattcggtgatcagcactgaacacagaggactcaccatggagtttttggctgagctgggttttccttattactattttaaaaggtgtccagtgtgaggtgcagttggtggagtctggaggaggcttggtccagccgggggggtccctgagactctcatgtgcggcctctgggctcaccgtcaacaccaactacatgagctgggtccgccaggctccagggaagaggccggagtgggtctcagttatttatgtcgacggtgccacattctacgcagactccgtgaggggcccggttcaccatcctccagagacaattccaagaacacggtgtatcttcaaatgaacagcctgagagccgatgacacggccgtgtattactgtgcgagagagtcggggcccacgtaacgttactaccgctagtggacgttcgtcgggggccgaaggggaccacggtccgaccgttcc

SEQ ID NO: 534387 - DNA, 492 bp, Homo sapiens
  misc_feature: HEFZJCU01EKUC3.53.27.C05.1.454.heavy.3.raw
cgcgtatacacacgaccggtgctcgatttagacgcgatcgaagggtttggggacccaacaaccacatccctcctcagaagcccccagagcacaacgcctcaccatggactggacctggaggatcctctttttggtggcagcagccacaggtgcccactcccaggtccagcttgtgcagtctggggctgaggcgaagaagcctggggcctcagtgaaggtttcctgccaggcttctggatacaccctcagtacccatgctatccattgggtgcgccaggcccccggacaaagacttgagtggatgggatggatcagcgctggcaatggtgacagacactattcacagaagttccagggcagagtcaccatcaccagggacacatccgcgagcacagcctacatggaactgagcagcctgagatctgaagacacggggtgtatattactgtgcgagagggagtgggatatgtagatgcgccaggtgcccggccc

SEQ ID NO: 534388 - DNA, 535 bp, Homo sapiens
  misc_feature: HEFZJCU01B5T7I.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacggggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttcgtggggcctatcggtaaccccggtaccg

SEQ ID NO: 534389 - DNA, 534 bp, Homo sapiens
  misc_feature: HEFZJCU01A2YIT.10.12.B01.1.454.heavy.3.raw
catagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctctttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaaggggctggaatggatgacagttatttcacacgatgcaaccaaaacatactacgcggagttcgtgaggggccgctgcatcgtctccagagacaattcgaagaacactctgtacctgacaaatgaacagttactgagagaccgaggacgaccgggcccgttcgttacctttttggtcgtcggaaccgtaagaaggtggggtagacgttagtaagggggtagtttt

SEQ ID NO: 534390 - DNA, 517 bp, Homo sapiens
  misc_feature: HEFZJCU01DO8QF.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccggccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaactcctactacggtctggacgtctggggccgaggggacc

SEQ ID NO: 534391 - DNA, 508 bp, Homo sapiens
  misc_feature: HEFZJCU01BSBQU.4.30.C08.1.454.heavy.3.raw
agcactgtagcacgaccggtgctcgatttagtctgacgtcaaagggaaaggggctcagagaggagccttagccctggactccaaggcctttccacttggtgatcagcactgagcacagaggactcaccatggaattggggctgagctgggttttccttgttgctattttagaaggtgtccagtgcgaggtgcagctggtggagtctgggggaggcttggtccagcctggggggtccctgagactctcctgtgcagcctctggattcacctttactacctattggatggactgggtccgccaggctccagggaaggggctggagtgggtggccaacataaaccaagatggaagtgaacagtactatgtggactctgtgaaggccgattcacatctcagagacaacgccaagaactcactgtatctgcaaatgaacagcctgagagccgaggacacggctatttattactgtgtagaagagaactggttcttgatctctggggccgtggt

SEQ ID NO: 534392 - DNA, 501 bp, Homo sapiens
  misc_feature: HEFZJCU01DDTZI.14.71.G05.1.454.heavy.3.raw
cgtctagtaccacgaccggtgctcgatttagtgtcgtcgcaagagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctgggggggtccctgagactctcctgtgcagcctctggattcgtctttagcagctatgccatgagctgggctcgccaggctccagggaaggggctggagtgggtctctgctattcctggcagtggtgatatcgaatactacgcagacctccgtgaagggccggttcactgtttccagagacaattccaagaacacactgtatctgcagatgaccagcctgagagccgaggacacggccgtatattactgtgcgaacgccaagattttggagtggttattatacctttga

SEQ ID NO: 534393 - DNA, 522 bp, Homo sapiens; identical to SEQ ID NO: 456265
  misc_feature: HEFZJCU01A0DOZ.12.40.D07.1.454.heavy.3.raw

SEQ ID NO: 534394 - DNA, 527 bp, Homo sapiens
  misc_feature: HEFZJCU01EDTEW.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaggcagttcgtgaacagttatggttggggggagttggggttttttttcgtacgtacgggt

SEQ ID NO: 534395 - DNA, 550 bp, Homo sapiens
  misc_feature: HEFZJCU01B5IQE.13.76.G10.1.454.heavy.3.raw
tcacgtactacacgaccggtgctcgatttagtcactcatacagggggggaggaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattccaccatctccagagacaattccaagaacacgctgtttctcaaatgaacagcctgagagccgatgacacggccgtgtattactgtgcggagaggtaggtccggggcccaacggtaaccgttaaccgtacgtacttatagggacgtcggtcggggaccgtaacggggaacccg

SEQ ID NO: 534396 - DNA, 507 bp, Homo sapiens
  misc_feature: HEFZJCU01A0ZUO.11.57.F02.1.454.heavy.3.raw
  modified_base (469)..(469): a, c, t, g, unknown or other
  modified_base (483)..(483): a, c, t, g, unknown or other
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaagggctggaatggatttcatacattagcagtagtggtgcgaccatatactacgcagactctgtgaagggccgattcatcatctccagagacaatggcaacaactcactgtatctggaaatcaacagcctgagagtcgaggacgacggctgttanattattagtgcggngacgccccctacgggtcgtaccgg

SEQ ID NO: 534397 - DNA, 492 bp, Homo sapiens
  misc_feature: HEFZJCU01BYE21.9.34.D01.1.454.heavy.3.raw
  modified_base (315)..(315): a, c, t, g, unknown or other
  modified_base (411)..(411): a, c, t, g, unknown or other
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctntgcgaaggagggcatatgggaagtacgattttcgatccctccgcagtcgacactttgattactggggccggggaacccgtggtcgccgtctcctcngcctccaccaacggcccactcggtcttcccctcggcacccctccctccaacgagaccacctctgggggccacacgcggccc

SEQ ID NO: 534398 - DNA, 544 bp, Homo sapiens
  misc_feature: HEFZJCU01DKHNN.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaattgggaggggcctttcatgtctgggcaagggacgctggtcaccgtctcttcagcctccaccaagggcccagtccggtcctttcccccgtcggccacccctcctccaagacgcaccctcgtggggggccac

SEQ ID NO: 534399 - DNA, 522 bp, Homo sapiens
  misc_feature: HEFZJCU01BVPCN.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaatttatgcggactccgtgaacggtcgattcaccatctccagagacaattccaggaacacactgtttctgcaatgaacagcctgagaattgaggacgtcgggtatatactactgtgccgtcgacccctcgactgactaaaccggacgttggttaccggtaccccgtcggggtcccgacggggaaccccgtggtacctaccgtcctcctccg

SEQ ID NO: 534400 - DNA, 515 bp, Homo sapiens
  misc_feature: HEFZJCU01BXXMW.51.58.F03.1.454.heavy.3.raw
cgatcgtatacacgaccggtgctcgatttagtctgatcgagaagggaaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcactgtctctggtggctccatcagcagcagtagttacttctggggctggatccgtcagcccccagggaagggactggagtggatagggaatgtccattatagtgggagcacctactacaatccgtccctcaacagtcgagtcaccatatccgttgacacgtccaagaaccaattcttcctgaggctgacctctgtgaccgccgcagatacggcagtttattactgtgcaagaagaactaccttgaaactgggaccacggaaccctggtcaccgtctcctcagcctccaccaagggcccatcggtt

SEQ ID NO: 534401 - DNA, 494 bp, Homo sapiens
  misc_feature: HEFZJCU01EBGUY.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactggtgggagagagtggaggtcgatattgt

SEQ ID NO: 534402 - DNA, 506 bp, Homo sapiens
  misc_feature: HEFZJCU01BUCA2.7.85.H08.1.454.heavy.3.raw
cgtgtctctacacgaccggtgctcgatttagtatcactcagtcggcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggattttaccttcagtacttatggcatgaactgggtccgccaggctccagggaaggggctgcagtggggtttcacacattaatactggaagtaggaccataacttacacagactctgtgaagggccgattcaccacctccagagacgacgccaagaactcactgtctctgcaaatgaacagcctgagagtcgaggacacggctgtgtattactgttgcgagagagtccggaggggacgtagtgacc

SEQ ID NO: 534403 - DNA, 505 bp, Homo sapiens
  misc_feature: HEFZJCU01EAOO9.11.19.B08.1.454.heavy.3.raw
  modified_base (499)..(499): a, c, t, g, unknown or other
cgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccagggaagggctggagtgggtttcatacatttctagtaattctggtaccatacactatgcagtctctgtgaagggccgattcaccatctccagagacaacgccaggaactcactttatcttgcaaatgagcagcctgagagtcgaggacacgggtatttattactgtgcgagagatagtctgtcttatgcttccgggganctaact

SEQ ID NO: 534404 - DNA, 404 bp, Homo sapiens
  misc_feature: HEFZJCU01D7E83.11.72.G06.1.454.heavy.3.raw
cgagagataccacgaccggtgctcgatttagctacgactgcaaggggaaaggggacccaaaaaccacacccctccttgggagaatcccctagatcatagctcctcaccatggactggacctggagcatccttttcttggtggcagcagctaacaggtgcccactcacaggggtcaacttggtgcagtctggacctgaggtgaagaagcctggggcctcagtgaaggtctcctgtaaggcctcaggttacaccttcaccgcctaatggtatcacctggcttcgacagcccctggacaggacttgagtcgggtgggatggatcgaactcgtcacactggaacgcagagtctagtgcggagagaacttccagggcaggagtcaacccttggaaccacgacgaggaca

SEQ ID NO: 534405 - DNA, 508 bp, Homo sapiens
  misc_feature: HEFZJCU01DTDM4.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcagttgtgttttcgagtcgtccgttcggtccgcgggtacttcgtggggcc

SEQ ID NO: 534406 - DNA, 512 bp, Homo sapiens
  misc_feature: HEFZJCU01CWPIL.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccgggtggccgtccgtacgacgacggccgttcgttcgtacttc

SEQ ID NO: 534407 - DNA, 497 bp, Homo sapiens
  misc_feature: HEFZJCU01DVD0L.4.87.H10.1.454.heavy.3.raw
agcactgtagcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaggaagcctggggcctcagtgaaggtctcctgcaagacttctggatacaccttcgccggctactatatgcactggattcgacaggcccctggacaagggcttgagtggatggggtggatcaacccttacagtggtgtcacaaactatgcacagaagtttcagggctgggtcaccgtgaccagggacacgtccgttcagcacagtttacatggaactgaggaaactgagatctgacgacacggccgtctactactgtgcgagagggtacacggttataccatctgcgctagta

SEQ ID NO: 534408 - DNA, 522 bp, Homo sapiens
  misc_feature: HEFZJCU01DJJEM.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggcaacgccaagaactcactgactttgcaaatgaacacctgcgagccgaggacacggccgtatattactgtgcgagaactaacccgttcgcctggttactttaccg

SEQ ID NO: 534409 - DNA, 489 bp, Homo sapiens
  misc_feature: HEFZJCU01BHBPC.48.38.D05.1.454.heavy.3.raw
agtatacatacacgaccggtgctcgatttagtatctgatagttgggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacgggccgtctattattgtttccagagataatcgccgtgaaataaagat

SEQ ID NO: 534410 - DNA, 518 bp, Homo sapiens
  misc_feature: HEFZJCU01ASDSZ.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggagcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgagttcaccatctccaaagacaatttgaagaacacgctgtttctgcaaatgaacagcctgagagctgaggacacggctgtgttattactgttcgtttggttctgactcgtcgggggaataccttcagcacgtggggccac

SEQ ID NO: 534411 - DNA, 523 bp, Homo sapiens
  misc_feature: HEFZJCU01A6R0L.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtacgaagacacggccgtatattactgtgcgagacatgacttcggtgaccccgtggggccagggaaccctggtccaccgtctcctcagt

SEQ ID NO: 534412 - DNA, 501 bp, Homo sapiens
  misc_feature: HEFZJCU01EDJTY.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcattctggggctgaggtgaagagccctggggcctcagtgaagatctcctgcgaggcttctggttacacctttaacacctatggcatctcctgggtgcgacaggcccctggacaaggacttgagtgggtggggtggtcagcgcttaccaagttggctacacaaattatgcacagaagttccaggacagagtcaccatgaccacagacacatccacgagcacagcctacatggaactgaggagcctgagatctgacgacacggccgtatattctgcgcgagagagtaaagtgacgtggtattccggggggacacatgacacc

SEQ ID NO: 534413 - DNA, 555 bp, Homo sapiens
  misc_feature: HEFZJCU01A8267.21.78.H01.1.454.heavy.3.raw
tcgtcgctcgcacgaccggtgctcgatttagtgtgagtagtttgggtttggggggggagaggagcccagcactgggattccgaggtgtttccattcggtgatcagcactgaacacagaggactcaccatggagtttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagaacaattccagaacacattgtatcttcaaatgaataacctgagagccgaggacacggccatgtattactcgtgtggggctatttacttcgacccctggggggcccgggggtaacccgtggttaccgacccgttcctcccccgacccctcccaaccaacc

SEQ ID NO: 534414 - DNA, 534 bp, Homo sapiens
  misc_feature: HEFZJCU01A0BYG.48.28.C06.1.454.heavy.3.raw
  modified_base (374)..(374): a, c, t, g, unknown or other
  modified_base (476)..(476): a, c, t, g, unknown or other
  modified_base (517)..(517): a, c, t, g, unknown or other
agtatacatacacgaccggtgctcgatttagagctcacgtattgggtttggggggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttcccngacgctgacgtctgtgaccgccgcagacacggctgtctattattgtgcgagactaggcttctgtagtggtgtactgcaaccgggatactactccaattcggnttggacatctggggccaagggacctcggtcgtccctttccncacgcctccaccaaggg

SEQ ID NO: 534415 - DNA, 501 bp, Homo sapiens
  misc_feature: HEFZJCU01BAD6W.51.37.D04.1.454.heavy.3.raw
cgatcgtatacacgaccggtgctcgatttagtagcatactgttgggtttggggagctctgggagaagagccccagtcccagaattcccaggagtttccattcggtgatcagcactgaacacagaggactcaccatggagtttgggctgagctgggtttttccttgttgctattatagaaggtgtccagtgtcaggtgcagctggtggaatctgggggaggcttggtcaagcctggagggtccctgagactctcctgtgcagcctctggattcaccttcagtggctacttcatgagctggatccgccaggctccagggaaggggctgcagtgggtctcacatattagtgctaatgggagaaccacattctacgcagactctgtgaagggccgattcctccatcctccagggacaacgccaagaactcactgtatctgcaatgaacagtctaagagccgaagacacggcctagtacttctgtgcgagtgtggggagaggtacg

SEQ ID NO: 534416 - DNA, 537 bp, Homo sapiens
  misc_feature: HEFZJCU01C4N1Z.47.78.H01.1.454.heavy.3.raw
agctcacgtacacgaccggtgctcgatttagtgtgagtagtttgggtttggggctctgggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaaggcagattcaccatctccagagatgattacaataaatatgtcatatctacaatggatagtcctagtaaaatcgaaggataacgaggtgtttaagttacttgttccacgagggtaagtcgcggttcgtcgtgggggaccgtaggggact

SEQ ID NO: 534417 - DNA, 544 bp, Homo sapiens
  misc_feature: HEFZJCU01CXFG5.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaaggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggacgtacggtgtactacgtgggggttcgtaccccgtggggccgacggggaaccctcggtcgaccgttccgtcctcgtacgccgttccaaccc

SEQ ID NO: 534418 - DNA, 513 bp, Homo sapiens
  misc_feature: HEFZJCU01DB2CV.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaacagcctgagaggcgaggacacggccgtgtattattgtgcggcgagatgatagtaggctctacagtagcaggtggta

SEQ ID NO: 534419 - DNA, 505 bp, Homo sapiens
  misc_feature: HEFZJCU01C5ET6.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccaacgactccggtgagcctacggcagccggcctttgacttct

SEQ ID NO: 534420 - DNA, 518 bp, Homo sapiens
  misc_feature: HEFZJCU01A6PM1.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggcccttcacagggcggtttgtcttctccatggatacctctgtcgggacggcttatctgcagataaccaaccttcaacctgacgacactgtccgtttattttgtacgagagcgtcgtctgtcagtggaattgactagtgggccagggaaccctggtcaccggtctcctc

SEQ ID NO: 534421 - DNA, 508 bp, Homo sapiens
  misc_feature: HEFZJCU01DCXQ5.51.56.F01.1.454.heavy.3.raw
  modified_base (335)..(335): a, c, t, g, unknown or other
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctganaactggtgccgcaaattatgcacaggagtttcggggcagggtcgtcatgaccggggacacgtccatcgccacgacttacatggaactgaccagtctgacatttgacgacacggccgtctattactgtgcgacagaagcggcggacagaggttcgcttactggttcgaggctcc

SEQ ID NO: 534422 - DNA, 535 bp, Homo sapiens
  misc_feature: HEFZJCU01DPNG3.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacgttttggggccgagggaaacctggtcaccgtctccccagccttccaccgtaacgggcccactcggtcctttcccccg

SEQ ID NO: 534423 - DNA, 377 bp, Homo sapiens
  misc_feature: HEFZJCU01CVWRL.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccagagcacctctgggggcacagcggccctgggctgcctggtcaggactacttcctacgtgagct

SEQ ID NO: 534424 - DNA, 511 bp, Homo sapiens
  misc_feature: HEFZJCU01B2IIS.12.30.C08.1.454.heavy.3.raw
atacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccatcacctgcaatgtctctggtggctccatcagcagtggtgattattactggagttggatccgccagtccccagggaagggcctggagtggattgggtacatctatcacagtgggagcacctactacatccccgtccctgaagagtcgaattacgatgtcagtaaacacgtctaggaaccagttctccctgaagctgaggtctgtgactgccgcagacacggccgtctactactgtgccagggtggctttgcgtccagtggttcagagatgatcgctttcgatttcggtggggccagggtaacg

SEQ ID NO: 534425 - DNA, 518 bp, Homo sapiens
  misc_feature: HEFZJCU01EH9E4.48.2.A02.1.454.heavy.3.raw
agtatacatacacgaccggtgctcgatttagactcatctacaggggaggtctcagagaggagccttagccctggactccaaggcctttccacttggtgatcagcactgagcacagaggactcaccatggaattggggctgagctgggttttccttgttgctattttagaaggtgtccagtgtgaggagcagctggtggagtctgggggaggcttggtccagccgtggggggtccctgagactctcctgtgttgcctctgggttcacatttcgtaacaattggatgacctgggtccgccaggctccagggaaggggctggagtgggtggccaatataaaccgagatggaaataagaatatactatgtggactctgttaagggccgattcaccatctccagagacaacgccaagagttcactgtttctgcaaatgagcagcctgagagccggaggacgacggctctatattactagtacgagagatttcacgcccctcccaaaggtaggtaaattattaa

SEQ ID NO: 534426 - DNA, 524 bp, Homo sapiens
  misc_feature: HEFZJCU01B7SJP.10.59.F04.1.454.heavy.3.raw
  modified_base (454)..(454): a, c, t, g, unknown or other
catagtagtgcacgaccggtgctcgatttagtacacacacttagggattggggggctttctgagagtcatggacctcctgtgcaagaacatgaatcacctgtggttcttcctcctgctggtggcggccccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattgggcctttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgntgaagattcctcaatgttactttgaccacgtgggggccaggggagcccgtggtccaccgtctccctcacg

SEQ ID NO: 534427 - DNA, 494 bp, Homo sapiens
  misc_feature: HEFZJCU01AUYTO.3.48.E04.1.454.heavy.3.raw
  modified_base (467)..(467): a, c, t, g, unknown or other
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtgcccagcctgggagtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaaacagcctgacgaggtcgaggacacgggccgttanatttattgtcgcccttggactttacta

SEQ ID NO: 534428 - DNA, 519 bp, Homo sapiens
  misc_feature: HEFZJCU01ELTEW.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatactattactgtgcgaaagcaaccggcaggttacgtccaaccctatactactttgactacgtggggaccc

SEQ ID NO: 534429 - DNA, 500 bp, Homo sapiens
  misc_feature: HEFZJCU01C2CFT.51.78.H01.1.454.heavy.3.raw
  modified_base (438)..(438): a, c, t, g, unknown or other
cgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccgcaagctccagggaaggcctggagtgggtctcacgtattagttggaatagtggtagtatagcctatgcggactctgtgaagggccgattcaccatctccagagacaacgccaagaactcctgtatctgcaaatgaanagtctgagagctgaggacacggccttgtattactgcgacaaaagccaaggcaacagctggta

SEQ ID NO: 534430 - DNA, 492 bp, Homo sapiens
  misc_feature: HEFZJCU01AIOQN.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattacgtgtggaaggacggcccccatacgacatgacccacctccgtcgtctggtgtct

SEQ ID NO: 534431 - DNA, 502 bp, Homo sapiens
  misc_feature: HEFZJCU01B2SA2.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagtttgtttgggcggggatagcagtcggacc

SEQ ID NO: 534432 - DNA, 529 bp, Homo sapiens
  misc_feature: HEFZJCU01DK7XH.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcaggactcaccatgaccacagaacaccatcagcgaacacagtacaacatggagttgcggagcctgcgatctgacgacgcggccgtatattactgtgcgagagtacgtaggcggcgtcgttcctttgtactactgggggcctggggaactcgtggtccaccgtcctccc

SEQ ID NO: 534433 - DNA, 492 bp, Homo sapiens
  misc_feature: HEFZJCU01D05X6.48.38.D05.1.454.heavy.3.raw
agtatacatacacgaccggtgctcgatttagtatctgatagttgggtttggggatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctggggtgccgacaggcccctggacaaggtcttgagtggatgggagtaatcgtcccttcttcaactagaacgcactacgcacagaagttcgaggacagagtcacatttatggtggataaagccacgagcacagtctacatgcagctgagcagctgagacacaacgacacggccgtcttattattgttccagagaattaactcgcgtagaataaagatata

SEQ ID NO: 534434 - DNA, 517 bp, Homo sapiens
  misc_feature: HEFZJCU01A03PJ.48.86.H09.1.454.heavy.3.raw
agtatacatacacgaccggtgctcgatttagtgctatagacttgggtttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaaggtctggagtgggtctcagtcatgggtacagctggtcacacatactatgcagactccgtaaagggccgattcaccatctccagagaagacgccaagaattccttgtatcttcagatgaacagtctgagaaccgatgacacggctgtgtattattgtgcaaaaggggggagcgagctcgcccatccacttcgactccgtggggccacgggaacctggtcaccgtctcctcagcctccaccaaggcccatccgtcttccccctggccaccctcctccaagacgcaccgtctc

SEQ ID NO: 534435 - DNA, 505 bp, Homo sapiens
  misc_feature: HEFZJCU01A8NRT.13.87.H10.1.454.heavy.3.raw
tcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctatttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtggtagcataggctatgcggactctgtgaagggccgattcaccatctccagagacaacgccaagaactccctgtatctgcaaatgaacagcctgagagctgaggacacggctgtattattgtgcaaagatccaacccttacgattttggagtggttacg

SEQ ID NO: 534436 - DNA, 515 bp, Homo sapiens
  misc_feature: HEFZJCU01ECCY1.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagacctaagagttgaggacgacggctgtttattactgtacgaaaggaggggggatacgaggtggcgagctaccaacgtacttacg

SEQ ID NO: 534437 - DNA, 521 bp, Homo sapiens
  misc_feature: HEFZJCU01A1FCD.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctagaacgaccgacggacacagccgtctattactgtgttagggtagttttacgtatttttggagttggatagttaa

SEQ ID NO: 534438 - DNA, 511 bp, Homo sapiens
  misc_feature: HEFZJCU01DZRQ8.11.72.G06.1.454.heavy.3.raw
  modified_base (444)..(444): a, c, t, g, unknown or other
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccgagggcagagtcaccctgaccacagagacatccacgaccacagtctacatggagctgtggagcctgagacctgacgacacggccctntattactgtgcgacggcctatcctacagtgaccactccacgctggttcgacctcgtcggggcctaac

SEQ ID NO: 534439 - DNA, 450 bp, Homo sapiens
  misc_feature: HEFZJCU01CGD9H.51.65.F10.1.454.heavy.3.raw
cgatcgtatacacgaccggtgctcgatttagctacgctctaagggggagcatcacccagcaaccacatctgtcctccagagaatccccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcgacaaagactgcacagtaagtttcagggcgagggtccactatagaccgagggacagtaccaccaacacacgcctaccatggaacgtaaggggactgacatctgacgacgacgg

SEQ ID NO: 534440 - DNA, 516 bp, Homo sapiens
  misc_feature: HEFZJCU01E15UW.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagccgacgacacgggcccatttattactgcgcgaaaggatatacgggtcgacaacggtaggctacgctttacgt

SEQ ID NO: 534441 - DNA, 493 bp, Homo sapiens
  misc_feature: HEFZJCU01DEA9P.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggccatcgtcttcccctggcaccctcctccaagagcacctctgggggcacagcggccctgggctgcctggtcaaggactactccgagtagtaca

SEQ ID NO: 534442 - DNA, 485 bp, Homo sapiens
  misc_feature: HEFZJCU01CC10N.19.21.B10.1.454.heavy.3.raw
  modified_base (302)..(302): a, c, t, g, unknown or other
tactctcgtgcacgaccggtgctcgatttagtgtcgtcgcaaggagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccccatcgagnggtctagagtggctgggaaggacatatttcatgtccaacacgtggaatacaaattatagcaccatctgttgagagtcgactgacaatacaacgtagacacatcgaagaaccagttctcctcgcagctcgacctctgttgactcccgaggaccgaacgggtcggttatattactgtggtaagga

SEQ ID NO: 534443 - DNA, 506 bp, Homo sapiens
  misc_feature: HEFZJCU01BYVK7.48.38.D05.1.454.heavy.3.raw
agtatacatacacgaccggtgctcgatttagtatctgatagttgggtttggggagctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggagtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacgacgctgtctattactgtgcgagagggcgtccgtagtttaacacgccgtac

SEQ ID NO: 534444 - DNA, 513 bp, Homo sapiens
  misc_feature: HEFZJCU01CDUGK.10.88.H11.1.454.heavy.3.raw
  modified_base (277)..(277): a, c, t, g, unknown or other
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagaacgtaaaacgtagacgtggtacgttccggggggtacgacatgacaccg

SEQ ID NO: 534445 - DNA, 524 bp, Homo sapiens
  misc_feature: HEFZJCU01DHUNU.10.34.D01.1.454.heavy.3.raw
  modified_base (412)..(412): a, c, t, g, unknown or other
catagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccatattaaaatcaaagctgatggtgggactaacagagcacgctgcacccgtgaaaggcagattcagcatctcaagagatgnttcaaaaagtacgctgtatctgaacatgaacagcctgaaaacggaggacacagccgtagtattactggttgcctactcaggaccgtaatatttgttcctgtagtcgggtacg

SEQ ID NO: 534446 - DNA, 502 bp, Homo sapiens
  misc_feature: HEFZJCU01A987U.11.71.G05.1.454.heavy.3.raw
  modified_base (485)..(485): a, c, t, g, unknown or other
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaacgggccgattcaccgtctccagagacaattccaggcacacgctgtatctgcaaatgaacagcctgagagctgaggacacggctgtgtattactgtgcgaaagtatttctataggaggtnacgtacgggggcgttcg

SEQ ID NO: 534447 - DNA, 492 bp, Homo sapiens
  misc_feature: HEFZJCU01CK72Z.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctattgctatgcactgggtccgccaggctccaggcgaggggctggagtgggtggcgattatatcacatgatggaactaatagacgctatgcgactccgtgaagggccgattcaccatctccagagacaattccaagaacacgcagtatctgcaaatgaacagcctgagagctgaggacacggctgtgtattactgtgggagagatggaggtcgatattgt

SEQ ID NO: 534448 - DNA, 508 bp, Homo sapiens
  misc_feature: HEFZJCU01BMGDO.10.23.C01.1.454.heavy.3.raw
catagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcagctttgatgaatatgccatggactgggtccggcaagttccagggaagggcctgggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagaggggagtcgagggtttctaaacg

SEQ ID NO: 534449 - DNA, 407 bp, Homo sapiens
  misc_feature: HEFZJCU01EYHGR.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaactgtgaggtgcagctggtggagtctgggggaggcttggtccagccaggggcggtccctgagactctcctgtacagcgtctggattcaactttcgtgattatgccaatgaactgggtccgcaggctccagggaggggctagggagtcgggtaggtttcagttagagccatggcttatgctgggacaacgagaactacgccgtcgtctgtgaaggcacgatc

SEQ ID NO: 534450 - DNA, 370 bp, Homo sapiens; identical to SEQ ID NO: 470167
  misc_feature: HEFZJCU01AXVCR.3.1.A01.1.454.heavy.3.raw

SEQ ID NO: 534451 - DNA, 515 bp, Homo sapiens
  misc_feature: HEFZJCU01BVXT3.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccactaaacacagcctacatggagttgaggagcctggacatctgacgacacggccgtctattactgtgcgagacgtcccacgatccggtgacgcctacggcagcggccttttgacttcgtggggccaggggacg

SEQ ID NO: 534452 - DNA, 526 bp, Homo sapiens
  misc_feature: HEFZJCU01BH695.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtcgtcggggccgaacgggaccacggtcagtcgtctcctcacgcctccaccaacgggccctagtcggtccttcccccgtcggccta

SEQ ID NO: 534453 - DNA, 565 bp, Homo sapiens
  misc_feature: HEFZJCU01DYIWL.48.59.F04.1.454.heavy.3.raw
agtatacatacacgaccggtgctcgatttagtacacacacttagggattggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcgttttcgatgcccttttgtaacttagttggttcgggggccgaaacgggggaccgaaagttgggtccgtaaccggttccttcctttcctaggcccttaccccgacccgaaacggggacccccg

SEQ ID NO: 534454 - DNA, 502 bp, Homo sapiens
  misc_feature: HEFZJCU01A69CN.13.11.A11.1.454.heavy.3.raw
tcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtctgggggaggtgtggtacggcctggggggtccctcagactctcctgtgcaacctctggattcagatttgatgagtatggcatacactgggtccgccaacctccagggaagggctgcagtgggtctctggtataaactggaatggtgccagcacaacttatgcagactctgtgaagggccgattcaccatctccagagacagtgccgagaactccgtacatctgcaaatgaacagtctcggagtcgaggacacggccttgtatttctgtgcgaggttagcaggtggctggtacttacggct

SEQ ID NO: 534455 - DNA, 545 bp, Homo sapiens
  misc_feature: HEFZJCU01DE3CQ.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtccttagactccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaatgaacaggcctgagaaccgaggacacacgccgtgtatttactgttacccacactccctcggaaacgcgtacaactactactactacggtatggacctcgtggggaccg

SEQ ID NO: 534456 - DNA, 502 bp, Homo sapiens
  misc_feature: HEFZJCU01CPICD.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacgatatcagccctgtcagtggtgccacaaagtttgcacagaactttcaggacagggtcaccatgaccacggacacgtccatcaaccacagcctacatggaactgaggagcctaagatctgacgacacggccgtttattattgtgcaataagaattgcaaacgatgcttttgatatgtggggaccg

SEQ ID NO: 534457 - DNA, 495 bp, Homo sapiens
  misc_feature: HEFZJCU01CUPUT.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgcctgctcagagcacctct

SEQ ID NO: 534458 - DNA, 525 bp, Homo sapiens
  misc_feature: HEFZJCU01B3TXG.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccggggggaggcttagttcagcctggggagtccctgagactctcctgtgtagtctctggaatcagtttcagtaccttctggatgcactgggtctgccaaactccaggtaaggggctggtggtgggtctcacgtatcaatcctgatggcagtgttataaattatacggactcgtggaggggccgattcagcatctccagagacaacggcaagagtatactgtatcgtggaaatgaacaatctagagtagtcgacgatacggctgtctatcattgtgttttcgatgcctttcggtccggcgggtacgttcgtggggccgagggtaacccg

SEQ ID NO: 534459 - DNA, 542 bp, Homo sapiens
  misc_feature: HEFZJCU01BM7BH.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctatttattgcgcgagagagacacacgaaccctactggccaatacctatgggggctttgttcgtgggggtccgagggggaccctggtcatcgtcctccccagccctccaccaacgggcccatcggtccttccccgtggccgccctcg

SEQ ID NO: 534460 - DNA, 502 bp, Homo sapiens; identical to SEQ ID NO: 456269
  misc_feature: HEFZJCU01DYTSV.17.10.A10.1.454.heavy.3.raw

SEQ ID NO: 534461 - DNA, 549 bp, Homo sapiens
  misc_feature: HEFZJCU01BN7ZS.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccaggggaagggcctggagtggatcgtcacttatttatagtggtggtaccacatactacacagactccgtgaagggccgattcaccatctcagaagacaattccaggaacacattgtatcttcaaatgaataacctgagtagccgtaggacacgggccagtgtattactgtggtggggcgtatttacttagaccccgtgggggcccggggaaccctgggtcacccggtctccccaccccgtccaacccg

SEQ ID NO: 534462 - DNA, 481 bp, Homo sapiens
  misc_feature: HEFZJCU01EM1ST.19.21.B10.1.454.heavy.3.raw
tactctcgtgcacgaccggtgctcgatttagtgtcgtcgcaaggagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaaggccctcgcagaccctctcgctcacctgtgccatctccggggacagagtcgctagcgacagtgttgcttggcactgggtcaggcagtccccatcgagtaggtctagagtggctgggaaggacatatttcatgtccaacacgtggaatacaaattatgcaccatctgttgagagtcgactgacaatcaacgtagacacatcgaagaaccaagttctccctgcagctgacctctgtgactcccgaggacacgggtgtatattactgtggaagaggcccc

SEQ ID NO: 534463 - DNA, 504 bp, Homo sapiens
  misc_feature: HEFZJCU01EMR0C.11.19.B08.1.454.heavy.3.raw
cgagagataccacgaccggtgctcgatttagtgagtcagtaaggggctcagagaggtgccttagccctggattccaaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccagggaaggggctggagtgggtttcatacatttctagtaattctggtaccatacactatgcagtctctgtgaagggccgattcaccatctccagagacaacgccaggaactcactttatctgcaaatgagcagcctgagagtcgaggacacgggtatttattactgtgcagagatagtctgtctatgcttccgggagtctaact

SEQ ID NO: 534464 - DNA, 510 bp, Homo sapiens
  misc_feature: HEFZJCU01A9MO4.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtaggatgggctggattaattccaaaagtggtggcacaagactgcacagaagtttcagggcaggggtcaccatgaccagggacaagtccaccaacacagcctacatggaactaaggggactgacatctgacgacacggccatgtattattgtgcgagagaaatgttaggtactgctttgggtccctggggccccgggaaccggggtcg

SEQ ID NO: 534465 - DNA, 523 bp, Homo sapiens
  misc_feature: HEFZJCU01BLUBR.10.85.H08.1.454.heavy.3.raw
  modified_base (411)..(411): a, c, t, g, unknown or other
catagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtaggccaccataaggaagatggaagtgagaactactttgtgggctctgtgaagggccgattcaccatctccagagacaacgccaagacgtnactgtatctgcaaatgaacgatgtgagagtcgaggacacggctgtatatttctgtgcgtaggggagccggctatggttacggaccttcgtggggccacggggaaccctgggt

SEQ ID NO: 534466 - DNA, 502 bp, Homo sapiens
  misc_feature: HEFZJCU01DF0TY.11.71.G05.1.454.heavy.3.raw
  modified_base (444)..(444): a, c, t, g, unknown or other
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagngctgaggacacggctgtcgtattactgttgacggaaagatttctatagaggtgactac

SEQ ID NO: 534467 - DNA, 504 bp, Homo sapiens
  misc_feature: HEFZJCU01DQ2H0.7.85.H08.1.454.heavy.3.raw
cgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctgggtggagtctgggggaggcttggttcagcctggggggtccctgagactctcctgtgcagcctctggatttaccttcagtacttatggcatgaactgggtccgccaggctccagggaaggggctgcagtgggtttcacacattaatactggaagtaggaccataacttacacagactctgtgaagggccgattcaccacctccagagacgacgccaagaactcactgtctctgcaaatagacagcctgagagtcgaggacacggctgtgtattactgtgcgagagagtccgggaggggacgtatcgacc

SEQ ID NO: 534468 - DNA, 501 bp, Homo sapiens
  misc_feature: HEFZJCU01AZ29N.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcacgtcagcactagcggagtgggtgtgggctggatccgtcagcccccaggaaaggccctggagtggcttgcactcatttattgggatgatgataagcgctacagcccatctctgatgaacaggctcaccatcaccaaggacgccgtccaaaaaccaggtggtccttacaatgaccaacatggaccctgtggacacagccacatattactgtgcacgagagatacgggcagcacgtggtttggggctacgtgggccagggaaccctgggtcaccgtctcctcacgcctccaccg

SEQ ID NO: 534469 - DNA, 532 bp, Homo sapiens
  misc_feature: HEFZJCU01BPHNQ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgacgaccagacgacacggctgtctattattgcgcgagagagacacacgaacctactggccaatactatgggggcttgttctggggccaggggaccctggtcatcgtctccccagccctccaccaacggcccatccggtcttccccctggccgccctcg

SEQ ID NO: 534470 - DNA, 513 bp, Homo sapiens
  misc_feature: HEFZJCU01BH7QD.10.28.C06.1.454.heavy.3.raw
  modified_base (427)..(427): a, c, t, g, unknown or other
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgaatagaaatagtggaaccatatactatgcagactctgtgaggggccgattcaccatctccagagacaatgccaggaattcactntatgtggaaatgaacagtctgagagccgaggacgacgggctctctattactgtcgcgtagagaccccgaaaatacgggtcgtaacg

SEQ ID NO: 534471 - DNA, 505 bp, Homo sapiens
  misc_feature: HEFZJCU01EGKKW.49.85.H08.1.454.heavy.3.raw
agtcgagagacacgaccggtgctcgatttagtatcactcagtcgcgggggtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcagcttctctgggttctcactctccagtcctggagtgggtgtgggctggatccgtcagcccccaggaaaggccctggagtggcttgcactcatttattggaatgacgataagacctacagcccatctctgaagagcaggctcaccatcaccaaggacacctccaacaaccaggtggtccttacaatgaccaacatggaccctgtggacacagccacatattactgtgcacacgtcccccgccgtattattatgatgctaggtggttattccaacgctgaattacttaccagcactggggccaggggccaccctcg

SEQ ID NO: 534472 - DNA, 521 bp, Homo sapiens
  misc_feature: HEFZJCU01B6RMO.3.82.H05.1.454.heavy.3.raw
  modified_base (349)..(349): a, c, t, g, unknown or other
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggctcagttattacaattctggtaccanatactactccgaccccgtgaagggccgattaaccatctccagagacgattccgagaacacggtgtatcttcaaatgaacaacctgagagccgacgacacggccgtttattactgtgcgagagatcgagtggttcggggacctccaccctcggttctacttcgattctcgttc

SEQ ID NO: 534473 - DNA, 523 bp, Homo sapiens
  misc_feature: HEFZJCU01DE88I.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttaatctgcaaatagacagcctgagaccagacgacacggctgtctattattgcgcgagagagacacacgaacctactggccaatactatgggggcttgttctggggccaggggaccctggtcatcgtctccccacgcctccaccaagggccatcggtcttcccctcggcg

SEQ ID NO: 534474 - DNA, 528 bp, Homo sapiens
  misc_feature: HEFZJCU01CKNNK.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactggggccagggaacccgtggtcaccgtctcctcagcctccaccaggcccatcggtcttcccctggccacctcctccaagagcacctctggggcacagcggccctgggctgcctggtcaaggactacgttcccg

SEQ ID NO: 534475 - DNA, 520 bp, Homo sapiens
  misc_feature: HEFZJCU01D7BPX.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaattttcgagaacacattgaatctacagatgaacagtctgagagccgagacacggctgtctattattgtgcgagagtaagtggtcatggtccttttgaccagtggggccagggaaccctggtcaccgtctcctcagcttccaccaagggcccatccggtcttccccctggccgccctcgctccaggacgcacctcctgggggcacagcc

SEQ ID NO: 534476 - DNA, 500 bp, Homo sapiens
  misc_feature: HEFZJCU01DBWA8.51.37.D04.1.454.heavy.3.raw
cgatcgtatacacgaccggtgctcgatttagtagcatactgttgggtttggggagctctgggagaagagccccagtcccagaattcccaggagtttccattcggtgatcagcactgaacacagaggactcaccatggagtttgggctgagctgggtttttccttgttgctattatagaaggtgtccagtgtcaggtgcagctggtggaatctgggggaggcttggtcaagcctggagggtccctgagactctcctgtgcagcctctggattcaccttcagtggctacttcatgagctggatccgccaggctccagggaagggctgcagtgggtctcacatattagtgctaatgggagaaccacattctacgcagactctgtgaagggccgattctccatctccagggacaacgccaagaactcactgtatctgcaaatgaacagtctaagagccgaaagcaacggccgtagtacttctgtgcgagtgtggggagaggacg

SEQ ID NO: 534477 - DNA, 512 bp, Homo sapiens
  misc_feature: HEFZJCU01DBBOB.16.21.B10.1.454.heavy.3.raw
  modified_base (443)..(443): a, c, t, g, unknown or other
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatggggtctcaggtattactggtgtggttataccacatactacgcagactccgtgaagggccggttcaccatctccagagacaattccaagaacacactgtatctgcaaatgaacagcctgagagccgacgacncggccatatattactgtgcgaaagcaccggcagttagtcacccatacctactttgactactggggaccg

SEQ ID NO: 534478 - DNA, 522 bp, Homo sapiens
  misc_feature: HEFZJCU01EWSFW.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattaactgtgcgagaaggacggtttttgggggcgtcggactcctcttgagatctggggccaggggacaatggtcaccgtctcttc

SEQ ID NO: 534479 - DNA, 498 bp, Homo sapiens
  misc_feature: HEFZJCU01DMRRX.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagttgagcagcctgagatctgacgacacggaccgtttattactgtgcgcgagataatagtcaacaactggaacggcgttttgggggt

SEQ ID NO: 534480 - DNA, 504 bp, Homo sapiens
  misc_feature: HEFZJCU01DBWI6.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaaatgagctgggtccgccaggctcctgggaaggggccggagtggatttcatacatcagtagtagtggtaaacaccttgtactatgcagactctgtgaagggcgattcaccatctccagagacaacgccaagaattcactgtttctgcaaatgaacagcctgagagacggaggagtacggctatttactagttagtgcgcgatcgacagaaaaagcggtggcctagtc

SEQ ID NO: 534481 - DNA, 535 bp, Homo sapiens
  misc_feature: HEFZJCU01CKH7M.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaactgatggtgggacaacagactacgctgcacccgtgaaaggcagattcaccatctcaagagatgattcaaaagcacgctgtatctgcaaatgaacagcctgacgaaccgaggacacagccgtggtattactgtaccacactcccctgaaacgcgtcaacgtactactactacggtatggacctc

SEQ ID NO: 534482 - DNA, 514 bp, Homo sapiens
  misc_feature: HEFZJCU01C9P89.12.40.D07.1.454.heavy.3.raw
  modified_base (357)..(357): a, c, t, g, unknown or other
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttanctgcaaatagacagcctgagaccagacgacacggctgtctattattgcgcgagagagacacacgaacctactggccaatactatgggggcttgttctggggccaggggaccctggtcatcgtctccccagcctccaccaggcccatcgtcttcccct

SEQ ID NO: 534483 - DNA, 504 bp, Homo sapiens
  misc_feature: HEFZJCU01DZR7G.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgtcgttagttacggacgtaattacgacgttttgattggtacg

SEQ ID NO: 534484 - DNA, 508 bp, Homo sapiens
  misc_feature: HEFZJCU01AL2SN.17.10.A10.1.454.heavy.3.raw
  modified_base (467)..(467): a, c, t, g, unknown or other
cgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggaccacccccacgaacacagtctaacatgcaactgacgagcctgagagctgacgacacggccgtctattactgtcgcgagaatgttttctgtnatcgtactaatttgataggcttctatggactggacttcgtc

SEQ ID NO: 534485 - DNA, 501 bp, Homo sapiens
  misc_feature: HEFZJCU01BG6QP.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgacgtacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggac

SEQ ID NO: 534486 - DNA, 480 bp, Homo sapiens
  misc_feature: HEFZJCU01C5H02.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagacacagcctacatggacctgagcggcctgacatctgacgacacggccgtatatttctgtgcgaggg

SEQ ID NO: 534487 - DNA, 543 bp, Homo sapiens
  misc_feature: HEFZJCU01AOSTT.17.28.C06.1.454.heavy.3.raw
  modified_base (447)..(447): a, c, t, g, unknown or other
  modified_base (456)..(456): a, c, t, g, unknown or other
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctgggggggtccctgagactctcctgtgcagcctccggattccccttcagtagttattggatgacttgggtccgccagactccagggaaggggctggagtgggtggccaacataaagcaagatggaactgccgagtttacgtggactctgtgaagggccgtttcaccatctccagagacaacgccaagaattcactgtatctacaactagaacagcctgagngtcgcaganacggccgtgtattactgtgcgagatgtaggaaaaagtaatggctgtgttttatttgggggccgacggggagccctgggtcgaccgtt

SEQ ID NO: 534488 - DNA, 378 bp, Homo sapiens
  misc_feature: HEFZJCU01EX5O1.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtctccccctggcgccctgctccaggagcacctctgggggcacagcgccctgggctgcctggtcaagggactacttcctacgtgagct

SEQ ID NO: 534489 - DNA, 342 bp, Homo sapiens
  misc_feature: HEFZJCU01EPDNI.52.78.H01.1.454.heavy.3.raw
cgcagtacgacacgaccggtgctcgatttagtgtgagtagtttgggtttggggctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaagggctggagtgggtggccagcgtgaagca

SEQ ID NO: 534490 - DNA, 482 bp, Homo sapiens
  misc_feature: HEFZJCU01BXO53.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggctagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggccacaaagtatgcacagaagtttcagggcagggtcaccatgaccagggacacgtccatcagcacgtccatcagcacagcctacatggacctgagcggcctgacatctgacgacacggccgtatatttctgtggcgaggg

SEQ ID NO: 534491 - DNA, 500 bp, Homo sapiens
  misc_feature: HEFZJCU01BS98C.17.10.A10.1.454.heavy.3.raw
  modified_base (462)..(462): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccaacggacacccccacgaaccacagtctacatgcaactgacgagcctgagagctgacgacacggccgtactattactgtgcgagaatgttttntgtcatcgtacatttgataggctctatggactggactt

SEQ ID NO: 534492 - DNA, 537 bp, Homo sapiens
  misc_feature: HEFZJCU01A0HEC.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagtttttaattattggtggggctggatccgccagcccccagggaaggggctggaatggattgggagtatattttataatggggacactctttacaacccatcccctcaagagtcgagtttccatatccgcagacacgtccgagaatcacttctccctgaaactgagctctgtgaccgccgcagacacggctgtttattactgttcgagacatgccgaccgagagcattatcggcaggttacggttttgattagtttggggccaaaggggaccaaggggtctacccgtctccggcagccctccgaacccg

SEQ ID NO: 534493 - DNA, 499 bp, Homo sapiens
  misc_feature: HEFZJCU01ATY63.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacaccggccgtatatttctgcgcgacgagacgtaaagtgacgtggtagttccggggggacac

SEQ ID NO: 534494 - DNA, 531 bp, Homo sapiens
  misc_feature: HEFZJCU01APRSC.10.44.D11.1.454.heavy.3.raw
catagtagtgcacgaccggtgctcgatttagcgcagtacgaagggggggagaggagcccagcactagaagtcggcggtgtttccattcggtgatcagcactgaacacagaggactcaccatggagtttgggctgaactgggtttttcctcgttgctctttttaagaggtgtccagtgtcaagtgcaactggtggagtctggggggaggcgttgggtccagcctggggaggtcacagagactctcctgtgcagcctctgggttcaccttcagtagctacggcatgcactgggtccgccaagcctccaggcaaggggattggagtgggtggcagtttgtttcatctgagggcagtgttcaatggtatgcagactcgtgaagggccgattcaccatctccagagacaattccaggaacacaatgtatttaggaatgaacagcctaagtcctgaggacgacgggtgtatactactgtacgaagggagggggaacaggcggagtccaagtactcctttagacgtcgtgggccgtac

SEQ ID NO: 534495 - DNA, 500 bp, Homo sapiens
  misc_feature: HEFZJCU01BIABO.51.38.D05.1.454.heavy.3.raw
cgatcgtatacacgaccggtgctcgatttagtatctgatagttgggtttggggctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatctatttgatggaagcaagaagtactatgcagactccgtgaagggccgagttctaccactctccagagacagttccgatgacacagtctatctacacatgagcagtgtgagacctgacgacacggcttctttttactgttgcgccaggaacgcagtgcgtgg

SEQ ID NO: 534496 - DNA, 509 bp, Homo sapiens
  misc_feature: HEFZJCU01BPRZI.17.25.C03.1.454.heavy.3.raw
cgtagactagcacgaccggtgctcgatttagtagtgtagatttgggtttgggggactcaacaaccacatctgtcctctagagaaaaccctgtgagcacagctcctcaccatggactggacctggaggatcctcttcttggtgggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatcccggtgacgcctacggcagcggcctttgactttctc

SEQ ID NO: 534497 - DNA, 525 bp, Homo sapiens
  misc_feature: HEFZJCU01A4RWP.48.21.B10.1.454.heavy.3.raw
  modified_base (296)..(296): a, c, t, g, unknown or other
agtatacatacacgaccggtgctcgatttagtgtcgtcgcaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggaggtntttaccacagtgggagcacctactaccaacccgtccctcaaaagtcgaaggcaccatatccgtagacacgtccaagaaccaattctccctgaagctgagctctgtgaccgccgccagacacggctgtctattactgtgcgaggccccgagcgcagtggcgttttgatgcctttcgtatatggttggggccgaaggggaaccgaagtaggtcgtaccgtccgttcttccg

SEQ ID NO: 534498 - DNA, 519 bp, Homo sapiens
  misc_feature: HEFZJCU01DE795.13.71.G05.1.454.heavy.3.raw
tcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctgggagtgggtttcgggtattagtgctcttgatgatagcacatactatgcagactccgttaagggccgcttcaccatctccagagacaattccaagaacacgctatatctgcagatgaacagcctgggagccggaggacacggccggtttatcactgtgtcgaaagattattgtaaatgatggtaagctgctactactatttttcgacttacgg

SEQ ID NO: 534499 - DNA, 521 bp, Homo sapiens
  misc_feature: HEFZJCU01C2UO4.2.81.H04.1.454.heavy.3.raw
  modified_base (500)..(500): a, c, t, g, unknown or other
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggtttttggatgagttgggtccgccaggctccagggaaggggctggagtgggtggccaacatagagtacgatggaagtgagaaaaactatgtgactccgtgaagggccgattcaccatctccagagacaacgacaagaatttagtgtatctgcaaatgaagcagcctgagagccgaggacncggctgtgtattatgtgcgag

SEQ ID NO: 534500 - DNA, 515 bp, Homo sapiens
  misc_feature: HEFZJCU01A2XLY.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcggagggggccgggatattgttataagaaccaacctgctatctgagcttggtcgactgctggggccagggaaccctggtctaccg

SEQ ID NO: 534501 - DNA, 491 bp, Homo sapiens; identical to SEQ ID NO: 446104
  misc_feature: HEFZJCU01EIKKN.3.34.D01.1.454.heavy.3.raw

SEQ ID NO: 534502 - DNA, 524 bp, Homo sapiens
  misc_feature: HEFZJCU01EY2IF.10.79.H02.1.454.heavy.3.raw
  modified_base (483)..(483): a, c, t, g, unknown or other
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtgggtgatacccatatactacgcagactctgtgaagggccgattcaccatctccagggacaacgccaagaactcactgactttgcaaatgaacaccctgcgagccgaggacacggccgtanattactgtgcgagaataacccgttcgcctggttatttaccg

SEQ ID NO: 534503 - DNA, 544 bp, Homo sapiens
  misc_feature: HEFZJCU01BRITK.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgttcgggggttacgaccccgttgggggcccaggggaaccctgggtcctaccggtccttcctcacgcctccaacccg

SEQ ID NO: 534504 - DNA, 496 bp, Homo sapiens
  misc_feature: HEFZJCU01D4EM7.12.14.B03.1.454.heavy.3.raw
atacgacgtacacgaccggtgctcgatttagtgtgagtagttccgcgggggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcagggatgggggctttgactcctgggcccagggaaccctggtcgcggtctcctcagcctccaccaagggcccatcggtcttcccctggcaccctcctccaagagcacctctgggggcacagcggccctgggctgcctggtcaggctacttctacgtcgtat

SEQ ID NO: 534505 - DNA, 511 bp, Homo sapiens
  misc_feature: HEFZJCU01D3IWK.7.28.C06.1.454.heavy.3.raw
  modified_base (383)..(383): a, c, t, g, unknown or other
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgagggccgattcatcatctccaganacaacgccgacaactcactgtctctgctgatgagcagcctgagagccgacgacacggctatctattactgtgcgaaactctcattccgttcatctgaatacgtgggccaggggaaccctggtcgtccg

SEQ ID NO: 534506 - DNA, 525 bp, Homo sapiens
  misc_feature: HEFZJCU01B686P.53.64.F09.1.454.heavy.3.raw
  modified_base (433)..(433): a, c, t, g, unknown or other
cgcgtatacacacgaccggtgctcgatttagcgcgtatacaaggggtctgagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcggggggaggcttggtacagccgggggggtccctgagactctcctgtagagtctctggcttcacctttagagtctatgacatgagttgggtccgccaggctccggggaaggggctggagtgggtctcaacgatcagtgatagcggaagtaccacaaactacgccgcctccgtgaagggccgatgcaccggtctcccagagacaattcgaaggacactttatatctgcaatcaacngactgacaacgctgacacggccgtctattactgtgtacaagaagacggaccgctggacaggagccagaggaaatcactactttgactacgtc

SEQ ID NO: 534507 - DNA, 516 bp, Homo sapiens
  misc_feature: HEFZJCU01A325R.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgaccgacgcggccgtatattactgtgcgagagtacgtagcggctcgtcctttgactactggggcctgggaactctggtcaccgtctcc

SEQ ID NO: 534508 - DNA, 492 bp, Homo sapiens
  misc_feature: HEFZJCU01C118S.48.38.D05.1.454.heavy.3.raw
agtatacatacacgaccggtgctcgatttagtatctgatagttgggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctgggggctgaagtgaagaagcctgggtcctcggtgagggtctcctgcaagacttctagagacaccttcaacagctatgctatcagctgggtgcgacaggcccctggacaaggtcttggagtggatgggagtaatcgtccttcttcaactagaacgcactacgcacagaagttcgaggacagagtcacatttatggtggataaagccacgagcacagtctacatgcagctgagcagcctgagacacaacgacacggccgtcatttattgttcctagaaggataaatcgcgtgaataaacgaat

SEQ ID NO: 534509 - DNA, 501 bp, Homo sapiens
  misc_feature: HEFZJCU01BDMHG.49.82.H05.1.454.heavy.3.raw
agtcgagagacacgaccggtgctcgatttagtcgagctctctcgcgggcacgaccggtgctcgatttagtacacgtgattagggattggggtctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaagggctggaatgggtggcacttatctcatctgatggaaggtctgatcttatgccgactccgtgaagggccgattcaccatctccagagacaattccaagaacacactatattcttaccaaattgaacacgtctgagacgtgaaagaacac

SEQ ID NO: 534510 - DNA, 510 bp, Homo sapiens
  misc_feature: HEFZJCU01C50BA.16.15.B04.1.454.heavy.3.raw
tgtactactccacgaccggtgctcgatttagacagtatatatccgcggggagctctgagagaggagcccagccctgggattttcaggtgttttcatttggtgatcagggctgaacagagagaactcaccatggagtttgggctgagctggctttttcttgtggctattttaaaaggtgtccagtgtgaggtgcagctggttggagtctgggggaggcttggtacagcctggggggtccctgagactctcctgtgcagcctctggattcatctttagcagctatgtcatgacctgggtccgccaggctccagggaaggggctggagtgggtctcagttattggtggtagtggttataccacatactacgcagactccgtgaagggccggttcaccatctccagagacaattccaagaacacactatatctgcaaatgaacagcctgagagccgaggacacggccgtatattactgtgcgaaggccagggtatagcagtggctggtacctac

SEQ ID NO: 534511 - DNA, 528 bp, Homo sapiens
  misc_feature: HEFZJCU01BC8GH.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctgggggaggcttggtccagccgggggggtccctgagactctcctgtacagcctctggattcactctcggaaacttttggatggtctgggtccgccaggctccagggaaggggctggagtgggtggccaatatacagtcaggtggaggtacgatacactatctcgactctgtgaagggtccggttcaccatctccagagacaacgccaagaattcactgtatctgcaaatgaacagcctgagagtcgaagacacgggtatttattattggttgtggcgtagatcgtggtatttcctttcgaaatgaagtgtggttcgatgtgtttg

SEQ ID NO: 534512 - DNA, 534 bp, Homo sapiens
  misc_feature: HEFZJCU01ETC4C.17.28.C06.1.454.heavy.3.raw
  modified_base (521)..(521): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctcagagacaacgccaagaattcactgtatctacaactgaacagcctgagagtcgcagacacggccgtgtattactgtgcgagatgtaggaaaaagtatggctgtgtttatggggccaggganccgtggtctaccg

SEQ ID NO: 534513 - DNA, 505 bp, Homo sapiens
  misc_feature: HEFZJCU01DA0KV.53.61.F06.1.454.heavy.3.raw
  modified_base (427)..(427): a, c, t, g, unknown or other
  modified_base (464)..(464): a, c, t, g, unknown or other
cgcgtatacacacgaccggtgctcgatttagctacgctctaagggaaagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactcgtgaagggccgattcaccatctcgagagacaattccaggaacacgctgtatntgcaatgaacggcctgagagctgaggacacggctgtntattactgtgcgtaaacggttgagtgggaagttaggggtcg

SEQ ID NO: 534514 - DNA, 491 bp, Homo sapiens
  misc_feature: HEFZJCU01AXXPR.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccaggggaggcttagttcagcctggggagtccctgagactctcctgtgtagtctctggaatcagtttcagtaccttctggatgcactgggtccgccaaactccaggtaaggggctggtgtgggtctccacgtatcaatcctgatggcagtgttataaattatgcggactccgtggaggggccgattcagcatctccagagacaacggcaagagtatactgtatctggaaatgaacaatctgagagtcgacgatacggctgtctatcattgtgttttcgatgcttcggtccgcggac

SEQ ID NO: 534515 - DNA, 504 bp, Homo sapiens
  misc_feature: HEFZJCU01EF25B.47.55.E11.1.454.heavy.3.raw
agctcacgtacacgaccggtgctcgatttagcactcgcacgttgggtttggggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaatgaacaatctgagagtcgacgatacggctgtctatcattgtgttttcgatgccttcggtccgcggggtacttcgtggggtcc

SEQ ID NO: 534516 - DNA, 523 bp, Homo sapiens
  misc_feature: HEFZJCU01EJORD.10.85.H08.1.454.heavy.3.raw
catagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtggagaactactttgtgggctctgtgaagggccgattcaccatctccagagacaacgccaagaagtcactgtatctgcaaatgaacgatgtgagagtcgaggacacggctgtatatttctgtgcgaggggagccggctagtcggttcggacctcgtggggccacggggtaaccctggt

SEQ ID NO: 534517 - DNA, 504 bp, Homo sapiens
  misc_feature: HEFZJCU01DI28R.51.82.H05.1.454.heavy.3.raw
cgatcgtatacacgaccggtgctcgatttagtcgagctctctcgcgggggctctgggagaggagcccagccctagaagtcggcggtgtttccattcggtgatcagcactgaacacagaggactcaccatggagtttgggctgagctgggttttcctcgttgctcttttaagaggtgtccagtgtcaagtgcaactggtggagtctgggggaggcgtggtccagcctgggaggtccctgagactctcctgcgtggcctctggattcaccttcaatagttatggcatgctctgggtccgccaggccccaggcagggggctggactgggtagcatctatatcgtacgatggagctgacgaatacctcgcagactccgtgaagggccgattcaccatctcaagagacaattccaagaacaccctgtttctgcaaatgaacagcctgagacctgcggacacggctatgtatttctgtgcgaaggttacgtgggacctactctggtcccg

SEQ ID NO: 534518 - DNA, 544 bp, Homo sapiens
  misc_feature: HEFZJCU01E1BWQ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcgttgttcgtgggggtccgacggggacccgtcggtcatcgtcctccccacgccctcccaccaacgggcccactccggtcttccccctcggccgccctcg

SEQ ID NO: 534519 - DNA, 520 bp, Homo sapiens
  misc_feature: HEFZJCU01EDS8W.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccaggccgggggggtccctgagactgtcctgtgtagtctctgggttcagcgtcagtcgcgaccacatgagttggttccgccaggctccagggaagggctggagtggctcgcacttatttatagtggtggtaccacatactacacagactccgtgaagggccgattcaccatctcagaagacaattccaggaacacattgtatcttacaaatgaataacctgagagccgaggacacggccatgtattactgtgtggggcatttacttgacccctggggcccggggaaccctggtcaccgt

SEQ ID NO: 534520 - DNA, 520 bp, Homo sapiens
  misc_feature: HEFZJCU01D5046.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcaccatcctccgggacagacttaccatgaccacgaactcctccataaacacagcctacatggagttgaggagcctgacatctgacgacacggccgtctattactgtgcgagagttcccgaacgtactccgggtgacggcctacggcctagccgggccttttcggaactttcctc

SEQ ID NO: 534521 - DNA, 530 bp, Homo sapiens
  misc_feature: HEFZJCU01DHQ55.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggtggagtctgggggaggcctggtacaggccgggggggtccctgagactctcctgtgtagcctccggattcacctttagcagacatggcatgagctgggtccgccaggctccgagggaaggggccggagtgggtgtcagtcattagtagtagtggtgatagaatttaccacacagactccgtgaagggccgcttcaccatctctagagacaattcccagaacacactgtatctgcaaatgactaggctgagagccgaacgacgaccggcccatttattacttgcgcgaaggataagtacgggtaccgacgaacgggtgcgtacgtccgttttctagt

SEQ ID NO: 534522 - DNA, 487 bp, Homo sapiens
  misc_feature: HEFZJCU01EHF8S.40.17.B06.1.454.heavy.3.raw
tctagcgactcacgaccggtgctcgatttagtcgatagtgaagggggcagagcctgctgaattctggctgactagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctggtaatagtgttgcttggaactggatcaggcagtccccatggagaggccttgagtggctgggaaggacatcctacaggtccgacaggtccgagtggttaaatgaatttgcagtttttgtggaaagtcgaataaccatcaatgcagacacatccaagaaccagttctccctgcacctaaactctatgactcccgaggacgcggctgtttattactgtgcaagaggaacgaattgcatact

SEQ ID NO: 534523 - DNA, 494 bp, Homo sapiens
  misc_feature: HEFZJCU01BSRWZ.40.81.H04.1.454.heavy.3.raw
tctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcgaccatgacctgggacgcgtccatcagcacagtctacatggatctgagcggactgacctctgacgacacggccatgtattactgtgagagacgtggtggctaccgcggggctgcactgggccg

SEQ ID NO: 534524 - DNA, 484 bp, Homo sapiens; identical to SEQ ID NO: 452752
  misc_feature: HEFZJCU01EKXVC.11.23.C01.1.454.heavy.3.raw

SEQ ID NO: 534525 - DNA, 545 bp, Homo sapiens
  misc_feature: HEFZJCU01DXVMB.17.28.C06.1.454.heavy.3.raw
  modified_base (479)..(479): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagacctgagagtcgcagacacggccgtgtattactgtncgagatgtaggaaaaagtaatggactggttgtttagttggggccaggggacgcccgtggtctaccc

SEQ ID NO: 534526 - DNA, 526 bp, Homo sapiens
  misc_feature: HEFZJCU01B5KDL.52.6.A06.1.454.heavy.3.raw
cgcagtacgacacgaccggtgctcgatttagatctactgacaggggtctgggagacgagcccagcactggaagtcgccggtgtttccattcggtgatcatcactgaacacagaggactcaccatggagtttgggcagagctgggttctcctcgttgttcttttaagaggtgtcctgtgcaggctctgcatttcccttcagtaactatgctatcgattgggtccgccaggctccaggcaagggactggagtgggtggcagttatatcagctgatggaggcaataagtattacgcagattctgcgagggccgattcaccatatccagagacaactcccaagatatgatatatctgcaaatgaacagcctgagacctggaggacgacggccgatactattattgtgcgtcgagggggcagtgccgtggccacgtgatgtcttttggtattttcgtcgggggccgaaggggactaacgtttcggtacctaccggttccttccctcacggtccctcccacccgaaacgggg

SEQ ID NO: 534527 - DNA, 504 bp, Homo sapiens
  misc_feature: HEFZJCU01ANA44.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgacagtgggccagggaaccctggtcaccgtctcctcagcttccaccaagggcccatcggtcttcccccgtggcgccctgctccaggagcacctcgtggggc

SEQ ID NO: 534528 - DNA, 535 bp, Homo sapiens
  misc_feature: HEFZJCU01AT9UE.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcactttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccccgttgggggaccggggtacccgtaggtcaccgtcctccccaccctccaacccg

SEQ ID NO: 534529 - DNA, 524 bp, Homo sapiens
  misc_feature: HEFZJCU01EUYH2.7.78.H01.1.454.heavy.3.raw
  modified_base (174)..(174): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagntggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggcagggaacctggtcaccgtctcctcagcctccacc

SEQ ID NO: 534530 - DNA, 528 bp, Homo sapiens; identical to SEQ ID NO: 499152
  misc_feature: HEFZJCU01CJB0L.16.27.C05.1.454.heavy.3.raw

SEQ ID NO: 534531 - DNA, 516 bp, Homo sapiens
  misc_feature: HEFZJCU01DBL9K.26.12.B01.1.454.heavy.3.raw
  modified_base (470)..(470): a, c, t, g, unknown or other
agactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccagggaggggcctggagtgggtctcaggtatcagttacaatagtggtaatatactctatgcggactcgtgtgaagggccgattcaccatcctccagagacaacgccaggactccctctatctagaaatggacagtctgacaactgaggacacggccttttattctgtncaaaggtggaaccgacatatttcacaagctaggcactggtacttcg

SEQ ID NO: 534532 - DNA, 523 bp, Homo sapiens
  misc_feature: HEFZJCU01AXUO8.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaatgaacaacctgagagccgacgacacggccggtttacttacttgtgcgagagagttcgagtgggttcggggacccgtcaccctggttctactttcggatctc

SEQ ID NO: 534533 - DNA, 362 bp, Homo sapiens
  misc_feature: HEFZJCU01BNXYS.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgtcccaggttcagttggtgcagactggggctggaggtgcagaagcctgggcatcagtgactgtctcctgcgaaggccagtggactatatcttacacaaaatatggttatgtaattgggttgacgactaggcccccggacaagggcctttggaggtgggtggggtgggtcagcggtctttgacggtaaggcacagtatgtcaccgaaga

SEQ ID NO: 534534 - DNA, 528 bp, Homo sapiens
  misc_feature: HEFZJCU01CX1ME.40.33.C11.1.454.heavy.3.raw
tctagcgactcacgaccggtgctcgatttagagtgagctcgttgggtttgggggagccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagcctgggggggtccctgagactctcctgtgcagcctctggagtcactctctccgcctactgggtactctgggtccgccaagctccagggaagggctggagtgggtcgcacgtatttataagatggatccacagcgtacgcggactccgtgaagggccgattcaccatctccagagacaacgccaagaacacagtgtctctgcaaatggacagtctgagagccgagacacgggtgtctattattgtacaaaagtggggactaatagaatatggtgtggacgtcgtggggaccgaagggaccacggtcgtcgtcc

SEQ ID NO: 534535 - DNA, 524 bp, Homo sapiens
  misc_feature: HEFZJCU01DPOZC.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaaggggattggagtggggtggcagtttgtttcatctgagggcagtgttcaatggtatgcagactccgtgagggccgattcaccatctccagagacaacttccaggaacacaatgtatttggaaattgaacagacctaagtcctgaggacacgggtgtatactactgtacgaaggaggggggaaccaggcgggagttccgaagtacttcc

SEQ ID NO: 534536 - DNA, 564 bp, Homo sapiens
  misc_feature: HEFZJCU01BIUH0.17.28.C06.1.454.heavy.3.raw
  modified_base (487)..(487): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctgggggggtccctgagactctcctgtgcagcctccggattccccttcagtagttattggatgacttgggtccgccagactccagggaaggggctggagtgggtggccaacataaagcaagatggaactgccgagtttacgtggactctgtgaagggtccgtttcaccatctccagagacaacgccaagaattcactgtatctacaactgaacagcctgagagtcgcagacacggccgtgtattactgtggcgaggtntggaaaggtaaaaagttagtcggcgttggttagttttaggtcggggcggtaagggcgtccggtcggtaccgtacccg

SEQ ID NO: 534537 - DNA, 500 bp, Homo sapiens; identical to SEQ ID NO: 446179
  misc_feature: HEFZJCU01AXN4R.19.86.H09.1.454.heavy.3.raw

SEQ ID NO: 534538 - DNA, 526 bp, Homo sapiens
  misc_feature: HEFZJCU01D5QJ0.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctggtccctcacctgcactgtctctggtgactccatcagcagtagtacttactactgggctggatccgccagcccccagggaacggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcgagggggccgggatattgttatagaaccacctggctactctgagcttgggttccgacgtggctgggggccaaggggaacccctggtcctacccg

SEQ ID NO: 534539 - DNA, 478 bp, Homo sapiens
  misc_feature: HEFZJCU01CMLQM.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctcccaccaagggcccatcggtcttccccctggcaccctcctccaagagcacctctgggggcacagcggccctgggctgcctggtcaaggactacttccgagtagtaca

SEQ ID NO: 534540 - DNA, 517 bp, Homo sapiens
  misc_feature: HEFZJCU01BWCFC.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatccgcctatctgcatatagaacagcctgaacgaccgaggacacgagccgtctattactgtgttagggtagttttacgtagtttttggta

SEQ ID NO: 534541 - DNA, 517 bp, Homo sapiens
  misc_feature: HEFZJCU01ETD1W.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgttgcgaaggaggcatatgggaagtacgattttcgatccctccgcagtcgacactttgattactggggccggggaaccctggtcgccgtctcctcagcctccacaagggcccatcggtcttcccctgcaccctcctccaagagcacctctgggggcacagcggccctgggctgcctggtcaggactacttccagtacgtatca

SEQ ID NO: 534542 - DNA, 525 bp, Homo sapiens
  misc_feature: HEFZJCU01B9IBK.12.39.D06.1.454.heavy.3.raw
  modified_base (495)..(495): a, c, t, g, unknown or other
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacaccttttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaaggccatcggtcttcccctggcaccctcctccagancacctctggggcacagcgccctggctgcct

SEQ ID NO: 534543 - DNA, 506 bp, Homo sapiens
  misc_feature: HEFZJCU01BFZ1R.14.14.B03.1.454.heavy.3.raw
cgtctagtaccacgaccggtgctcgatttagtgtgagtagtttgggtttgagggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccaggggacaacgccaagaactcgctgtatctgcaaatcgacggcctgagagtcgaggacacggccatgtattactgtgcgagagtgtggttcggtcatgtttagaagttggggcttttgaccactggggccagggaccctggtcaccgtctcttcagcctccaccagggcccatcggtcttcccctggtcaccctcctccaagagcacctctgggggcacgagcggccctgggctgcctggtcaaggactacttccgtactagacg

SEQ ID NO: 534544 - DNA, 533 bp, Homo sapiens
  misc_feature: HEFZJCU01DPFEE.49.67.G01.1.454.heavy.3.raw
agtcgagagacacgaccggtgctcgatttagagtatacatattgggtttgggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattaccccgagacacttccgcgaacacagccctacatggaactgagcggcctgagatttgaagacacggctggtgtattactgttgcgtagagcaacggtcgtcatgggatttgactacgtggggccacgggaaccccggtcaccgtctcctcgtcgccttacccg

SEQ ID NO: 534545 - DNA, 504 bp, Homo sapiens
  misc_feature: HEFZJCU01BBH5W.26.37.D04.1.454.heavy.3.raw
agactatactcacgaccggtgctcgatttagtagcatactgttgggtttggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggagcaggtagtggagtctgggggaggcgtggtccagcctggggggtccctgagactctcctgtgcagcctctggattcaccttcagtacctacgccatgcactggatccgccaggctccaggcaaggggctagagtgggtggctcttatatcatatgatggaagtaatgaacattacgcagactccgtgaagggccgattcaccgtctccagagacaattccaagagcacgatgtttctgcaaatgaacagcctgagagttgaggacacgggtgtctatttctgtgcgcgagtcgggtgaggggtgtcctac

SEQ ID NO: 534546 - DNA, 490 bp, Homo sapiens
  misc_feature: HEFZJCU01A56GR.49.82.H05.1.454.heavy.3.raw
agtcgagagacacgaccggtgctcgatttagtcgagctctctcgcgggtctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccagggaagggactggagtgggtttcatacattagtcggagagtcaacaccgtattctacacagactctgtcaggggccgattcaccatctccagagacaacgccaagaactcactgtatctccaaatgaacagcctgagagtcgaggacacggctgtctattactgtgcgagagatcccaaacagcgg

SEQ ID NO: 534547 - DNA, 489 bp, Homo sapiens
  misc_feature: HEFZJCU01C7Z3O.19.13.B02.1.454.heavy.3.raw
  modified_base (460)..(460): a, c, t, g, unknown or other
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcgaaggggctggagtgggtggcagttatatcatatgatggaagtaataaatactatgcagactccgtgaagggccgattcaccatctccagagacaattccaagaacacgctagtatctgcaaatgaacagcctgagagctgaggaacncggctgtgtattacgtgtgcgaggcggtt

SEQ ID NO: 534548 - DNA, 530 bp, Homo sapiens
  misc_feature: HEFZJCU01CVLXB.8.34.D01.1.454.heavy.3.raw
  modified_base (497)..(497): a, c, t, g, unknown or other
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagttgttcaatggtatgcagactccgtgaagggccgattcaccatctccagagacaattccaggaacacaatgtatttggtagctgaacacgctaagtccctgtaggacacggggcgtagtactactgtacaagggacggggggaacgaacggngggaggtccaacgtaactcctttcgtacgtctc

SEQ ID NO: 534549 - DNA, 487 bp, Homo sapiens
  misc_feature: HEFZJCU01CJJEE.13.86.H09.1.454.heavy.3.raw
tcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagccgtgagatatgacgacacggccgtgtattattgtgcgagaggtggagtggcaggtggatatcgacaaa

SEQ ID NO: 534550 - DNA, 531 bp, Homo sapiens
  misc_feature: HEFZJCU01BY07R.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggtttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagtacgctatgccgactccgtgaagggccggattcaccatctccagagacaattccaagaaccacgcagtatctgcaaatgaacagccttgagagctggacgggaacgacgggtcctgtgttatttaacctggttggggaggaaggtagtgggtagggtttggtaattagttagttaa

SEQ ID NO: 534551 - DNA, 522 bp, Homo sapiens
  misc_feature: HEFZJCU01A8VZ8.12.11.A11.1.454.heavy.3.raw
  modified_base (469)..(469): a, c, t, g, unknown or other
atacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgccaggctccagggaaggggctggagtgggtggccaacataaagcaagatgggaagtgagaaatactatgtggactctgtgaagggccgattcacaatctccagagacaacgccaagaactcactgtatctgcaaataacagcctagaaagccgaggacacggctgtgtatttcngtgcggaggacgtcctacggtgaactaatttatacaaaccagacaaagtttcg

SEQ ID NO: 534552 - DNA, 537 bp, Homo sapiens
  misc_feature: HEFZJCU01B3Y7P.21.78.H01.1.454.heavy.3.raw
tcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattaactgtgtggggcagtttacttgacccctgggggccggggaacccgtgggtccaccgtctccccaccctcccaccgaac

SEQ ID NO: 534553 - DNA, 537 bp, Homo sapiens
  misc_feature: HEFZJCU01D30D8.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagctggcttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatctgcaattgaccagcctgagcgccaggacacggccgatgtattactgtactaaatcgtcgggtggccggcggccggtaccgtccggagtggttttgattttcgtcggggccgtaagggaacg

SEQ ID NO: 534554 - DNA, 521 bp, Homo sapiens
  misc_feature: HEFZJCU01D4YPS.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctgggattcacctttagtaggtttttggatgagttgggtccgccaggctccagggaaggggctggagtgggtggccaacatagagtacgagtgaagtgagaaaaactatgtggactccgtgaagggccgattcaccgatctccagacgacaacgacaagaatttagtgtatctgcaaatgagcagcctgagagccgaaggacacggctgtgtattattgt

SEQ ID NO: 534555 - DNA, 487 bp, Homo sapiens
  misc_feature: HEFZJCU01D0C2O.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagttttgttgggcggg

SEQ ID NO: 534556 - DNA, 545 bp, Homo sapiens
  misc_feature: HEFZJCU01EBL42.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaactttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaaggcccatcggtccttcccctcggccaccctccctccaagagcacctcgtgggggccacgacgccggccccgtggggctcggccctcgggtcaaagggacctaacttcccggagtacgtaactacg

SEQ ID NO: 534557 - DNA, 492 bp, Homo sapiens; identical to SEQ ID NO: 445919
  misc_feature: HEFZJCU01DY1CD.14.25.C03.1.454.heavy.3.raw

SEQ ID NO: 534558 - DNA, 346 bp, Homo sapiens
  misc_feature: HEFZJCU01C8ZSN.48.78.H01.1.454.heavy.3.raw
agtatacatacacgaccggtgctcgatttagtgtgagtagtttgggtttgggggattcccaggtgtttccattcagtgatcagcactgaacacagaggactcaccatggagttgggactgagctggattttccttttggctattttaaaagctgtccagtgtgaagtgcacctggtggagtctgggggagcttgggtacagcctggcaggtccctggagactctccgtgtgcagcctcgtggattcacctttgatgattatgccatgcactgggtcccggacaagttccaagggaagggcctgggaggtgggtctcgaggctagttagtagtaattagggggtagc

SEQ ID NO: 534559 - DNA, 500 bp, Homo sapiens
  misc_feature: HEFZJCU01E147Y.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatgtactcgtcccccggactttacg

SEQ ID NO: 534560 - DNA, 527 bp, Homo sapiens
  misc_feature: HEFZJCU01DLZNA.3.82.H05.1.454.heavy.3.raw
  modified_base (439)..(439): a, c, t, g, unknown or other
agacgcactccacgaccggtgctcgatttagtcgagctctctcgcgggggggagaggagcccagcactgggattccgaggtgtttccattcggtgatcagcactgaacacagaggactcaccatggagtttttggctgagcgtgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagngccgacgacacggtccgtttattactgtgcgagagattcgagtggttcggggacctcaccctggttcctattcgatctctgggccgtc

SEQ ID NO: 534561 - DNA, 525 bp, Homo sapiens
  misc_feature: HEFZJCU01BAJ8Y.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacacgcctacatggagttgaggagcctgacatctgacgacacggccgtctattactgtgcgagacgtcccacgactccgggtgacgcctacggcaggccggccttttcggactttcgtcggggccgagggggaccg

SEQ ID NO: 534562 - DNA, 507 bp, Homo sapiens
  misc_feature: HEFZJCU01EINGA.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctcggggccagggacg

SEQ ID NO: 534563 - DNA, 496 bp, Homo sapiens
  misc_feature: HEFZJCU01BDXYX.13.86.H09.1.454.heavy.3.raw
tcacgtactacacgaccggtgctcgatttagtgctatagacttgggttttggggcacccaaaaaccacacccctccttgggagaatccctagatcacagctcctcaccatggactggacctggagcatccttttcttggtggcagcagcaacaggtgcccactcccaggttcagctggtgcagtctgcagctgaggtgaagaagcctggggcctcagtgaaggatctcctgcaaggcttctggttacacctttagcagctatcttatcagctgggtgcgacaggcccctggacgaggactcgagtggatgggatggatcagcccttacaacggaaacacagactatggacagaacctccagggccagattcaccatgacgacagacacatacacgaacacagcctaacatggaggtgaggagcctgagatatgacgacacggccgtgtattattgtgacgagagtggagtggcaggtgatatcgacaaattactaa

SEQ ID NO: 534564 - DNA, 522 bp, Homo sapiens
  misc_feature: HEFZJCU01CN3JG.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggggccgaattcaccatcctccagagacaatttcgagaacacattgaatctacagatgaacagtctgagagccgaggacacggctgtctattattgtgcgagagtaagtggtcatggtccttttgaccagtggggccagggaacctggtcaccgtctcctcagcttccaccagggcccagtcggtcttcccctcggccgccctgctccaggagcacctcgtgggggcacgagccggcccg

SEQ ID NO: 534565 - DNA, 499 bp, Homo sapiens
  misc_feature: HEFZJCU01A1VDR.52.77.G11.1.454.heavy.3.raw
cgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcaccttcagtgtctatgacatgcactgggtccgccaggctccaggcaaggggctggagtgggtggcagttatatcatatgatggaagtaagatatactatgcagactccgtgaagggccgattcaccatttccagagacaactccaagaacacgctgtatttgacaaatgaacagcctgagagctgaggacacggctgtgtattactgtgcgaacgttatcacggaggacgtaac

SEQ ID NO: 534566 - DNA, 495 bp, Homo sapiens
  misc_feature: HEFZJCU01EIHR9.12.75.G09.1.454.heavy.3.raw
  modified_base (423)..(423): a, c, t, g, unknown or other
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcagggcttctggaggcaccttcaacaactatgctgtcagctggatgcgacaggcccctggacaaggggcttgagtggatgggaggagtcatccctctctttcgttcagcagactacgcacagaaattccaggacagaagtcacgattaccgcggacgaatccacgacccacagcctacatagagctgcgcagcctgagatctgaagacacggccatttattactgtgcgagngatgcagggccctcccacatcggttatttctttgactcctggggccacgggaaccctggtcaccgtctcctc

SEQ ID NO: 534567 - DNA, 519 bp, Homo sapiens
  misc_feature: HEFZJCU01AHO7K.17.33.C11.1.454.heavy.3.raw
  modified_base (422)..(422): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttacncgctctatggttcggggagttattagtccctaacgtttgactacgtggggccgagggaactcgtggtcaccgtatccgcagcctccaccaagggccc

SEQ ID NO: 534568 - DNA, 539 bp, Homo sapiens
  misc_feature: HEFZJCU01C4IW8.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttaatcctgcaaatagacagccctgagaccagacgacacggctgtctattattgcgcgagagagacacacgaacctactggccaatactaatgggggtcttgttctgggggccgagggggaccctggtcattcgtctccccagccctccaccaacgggcccatcggtcttccccctggtccgcctcg

SEQ ID NO: 534569 - DNA, 487 bp, Homo sapiens; identical to SEQ ID NO: 454270
  misc_feature: HEFZJCU01CYJ0I.3.48.E04.1.454.heavy.3.raw

SEQ ID NO: 534570 - DNA, 499 bp, Homo sapiens
  misc_feature: HEFZJCU01B090K.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacaccccacgaacacagtcctacatgcaactgacgagcctgagagctgacgacacggccgtctattactgtgcgagaatgttttctgtcatctacatttgataggctctatgactggacttcgtc

SEQ ID NO: 534571 - DNA, 512 bp, Homo sapiens
  misc_feature: HEFZJCU01BFQQD.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctagaatactggggccagggaaccctggtcgtccg

SEQ ID NO: 534572 - DNA, 540 bp, Homo sapiens
  misc_feature: HEFZJCU01DF0HS.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagtttccctgtacgctgacgtctgtgaccgccgccagacacggctgtctattattgtgcgagactagccttctgtaggtggggggtactttggcaaccccggggatactaccttcctaacccttcgggtccttgggtacatcttcgggggcccggtac

SEQ ID NO: 534573 - DNA, 492 bp, Homo sapiens
  misc_feature: HEFZJCU01CW4E4.13.71.G05.1.454.heavy.3.raw
tcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggaggcgtggtccagcctggggaatccctgacactgtcttgtgtagcctctggattcagcttcagaacctatggcatgcactgggtccgccaggccccaggcaaggggctggagtggctgactctttatcatatgatggaagtcaaaaattctatgcagactccgtgaagggccgattcaccgtctccagggacaactccaagaacaccttatatctgcacgatgaacagcctgagaggtgacgactcggctgtatacttctgtgcgacaacatgatgtttggagtggatgtgtta

SEQ ID NO: 534574 - DNA, 511 bp, Homo sapiens
  misc_feature: HEFZJCU01AU067.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggaccgtatatttctgcgcgagagacgtaaagtagacgtggtagttccggggggacgacatgactaccgg

SEQ ID NO: 534575 - DNA, 529 bp, Homo sapiens
  misc_feature: HEFZJCU01EMRXC.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttacctacgcctaatcggacgtcgtggggccgaacggggaaccg

SEQ ID NO: 534576 - DNA, 510 bp, Homo sapiens
  misc_feature: HEFZJCU01DS7RF.17.25.C03.1.454.heavy.3.raw
  modified_base (455)..(455): a, c, t, g, unknown or other
  modified_base (473)..(473): a, c, t, g, unknown or other
cgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctcataaacacagcctacatggagttgaggagcctgacatctgacgacacggccgtctattactgtgngagagtcccagatccggngacgccctacggccaggccggccttttggacttcgtc

SEQ ID NO: 534577 - DNA, 538 bp, Homo sapiens
  misc_feature: HEFZJCU01ENKH0.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagacctaagtcctggaggacgacgggcgtatacttactgttacgaaagggaaggggggaaaccgaggacggggacggttaccgaacggtacctttccgtttgtacc

SEQ ID NO: 534578 - DNA, 509 bp, Homo sapiens
  misc_feature: HEFZJCU01AJTAJ.5.57.F02.1.454.heavy.3.raw
atcagacacgcacgaccggtgctcgatttagctcgatatagttgggtttggggaactctgagagaggagcccagccctgggattttcaggtgttttcatttggtgatcaggactgaacagagcgaactcaccatggagtctgggctgacctggctttttcttgtgactattttaaaaggtgtccactgtgacgtgcagatcttggagtctgggggacgcttcgagcggccggggggatccgtgagactctcctgctcaacctctggattcacatttgtcctttacgccatgacttgggtccgccaggctccagggagggggccagagtgcgtcgcaagtattggcagtgtgaaatttgactaccttatatgcagactctgtgaggggccgcttcaccgtgtccagagacaactccaagaacgccgtctatttgcagatggacagcctgagagtcgacgacgacgggcatctattatgtacggcggccgagcgaaatctactcttacttt

SEQ ID NO: 534579 - DNA, 518 bp, Homo sapiens
  misc_feature: HEFZJCU01AS4QF.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagaacaacggcaagagtatactgtatctggaaatgaacaatctgagagtcgacgatacggctgtctatcattggtgttttcgattcgccttcggtccgtcgggacttcgtggggccgagggtacccg

SEQ ID NO: 534580 - DNA, 394 bp, Homo sapiens
  misc_feature: HEFZJCU01AP2WS.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgttctgcaaatgaacagcctgagagccgaggactcggccacatattactgtgcgagaggaattttgactggttattcctactactttgactactgggccagggcactccggtcaccgtctcctcagcctccaccaagggcccatcggtcttccccctggcaccctcctccaagagcacctctgggggcacagcggccctgggctgcctggtcaaggactacttcccatactcgta

SEQ ID NO: 534581 - DNA, 527 bp, Homo sapiens
  misc_feature: HEFZJCU01DE1ZB.40.20.B09.1.454.heavy.3.raw
tctagcgactcacgaccggtgctcgatttagtgtagtgtgaagggggctctgagagaggagccttagccctggattccaaggcctatccacttggtgatcagcactgagcaccgaggagtcaccatggaactgggactccgctgggttttccttgttgcgattttagaaggtgtcaagtgtgaggtgcgactggtcgagtctgggggaggcctggtcaagccgggggggtccctgagactctcctgtgcagcctctggactcaccttcaggagtttcagtatgaattgggtccgccaggctccagggaaggggctggagtgggtctcatccatcagcagtggtagcacttacatacactatgcagactcagtgaagggccgattcaccatctccagagacaacgccgggaactccctgtatctgcaaatgaagagcctgcgagccgaggacacgggtgtttattattgtacgtaaaggacaaagaggggtactttggggagttactactacggtatggaacgtcgtc

SEQ ID NO: 534582 - DNA, 398 bp, Homo sapiens
  misc_feature: HEFZJCU01AP0X4.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggccgccctgcctccaggagcacctccgagagcacagcggccctgggctgcctggtcaaggactacttcctacgtgagct

SEQ ID NO: 534583 - DNA, 508 bp, Homo sapiens
  misc_feature: HEFZJCU01E1MNO.10.38.D05.1.454.heavy.3.raw
  modified_base (476)..(476): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacntgactacgctctaattctggggccgagggacg

SEQ ID NO: 534584 - DNA, 502 bp, Homo sapiens
  misc_feature: HEFZJCU01EQJBL.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgacaaatgaacagcctgagagccgaggacacggctgtgtattactgtgcgagaggagctattatctcggaaccccgat

SEQ ID NO: 534585 - DNA, 523 bp, Homo sapiens
  misc_feature: HEFZJCU01EJZLD.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacgggttttggggcgcggctcctcttgagatcgtggggccaggggacaagtggtcaccgtctcttcagt

SEQ ID NO: 534586 - DNA, 509 bp, Homo sapiens
  misc_feature: HEFZJCU01ELDH6.49.49.E05.1.454.heavy.3.raw
agtcgagagacacgaccggtgctcgatttagagcgactagcaacacacaaagggggctttctgagagtcatggatctcatgtgcaagaaagtgaagcacctgtggttcttcctcctgctggtggcggctcccagatgggtcctgtcccagctgcagctacaggagtcgggcccaggactgctgaagccttcggagaccctgtccctcacctgcactgtctctggtggttccttcagtagtccttattactactggggctgggtccgccagcccccagggaagggcctggagtggattgcgaatatctactatagtgggagcacctactacaatccttccctcaagagtcgcgtcactgtgtccgtggacacgtccaagaataaagtctccctgaacctgaactctgtgaccgccgcagacacggctgtctattactgtgccagaacgcggaaatccctacacaatgatgcttttgattgtcgtggggccagtgggacaatggtcaccgt

SEQ ID NO: 534587 - DNA, 519 bp, Homo sapiens
  misc_feature: HEFZJCU01D0K1O.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacaccttacatgagctgggtccgccaggctccagggaaggggctggagtgcgtctcttttatttatagtagtggtagtacatacttccgcagactccgtgagggggccgattcaccatctccagagacaattccaagaacacgctgtttcttcaaatgaacagcctgagagccgatgacacggccgtgtattactgtgcgagagagtcggggcccacggaacgttactacgctagtggacgtcgtgggggcc

SEQ ID NO: 534588 - DNA, 508 bp, Homo sapiens
  misc_feature: HEFZJCU01BQRDH.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggcaggcggcctttggactttcgtc

SEQ ID NO: 534589 - DNA, 532 bp, Homo sapiens
  misc_feature: HEFZJCU01D4R5F.17.34.D01.1.454.heavy.3.raw
cgtagactagcacgaccggtgctcgatttagatcgtctgtgttgggtttggggacaaaacaaccagattcctcctctaaagaagccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacgaacgggcttctacttctgtgcgaggagtaattactataacactgctcttttacaccttccttcgacttctggggccagtggaaccccggtccaccgt

SEQ ID NO: 534590 - DNA, 468 bp, Homo sapiens
  misc_feature: HEFZJCU01C6PN9.48.59.F04.1.454.heavy.3.raw
agtatacatacacgaccggtgctcgatttagtacacacacttagggattgggtagggattggggcagggtgtacacctgtggttctcggggctgccctttggctttggagatggttttctcgatggggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 534591 - DNA, 530 bp, Homo sapiens
  misc_feature: HEFZJCU01BELLL.2.53.E09.1.454.heavy.3.raw
acgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacaagggcttgagtggatgggatggatcagtgcttacaacggtaacacaaactatgcacagaagttccagggcagagtcaccctgaccacagacacatccacgagcacagtcaacctggacctgaggagcctgacatctgacgacacggccgtgtattattgtgcgagaggacggagggggggagcggacggtcccttttgactacgtgggggccagggaacccgtgggtcaacccggtctcctcgagtccctcctaccgaaacgggccccg

SEQ ID NO: 534592 - DNA, 526 bp, Homo sapiens
  misc_feature: HEFZJCU01EDD9V.7.78.H01.1.454.heavy.3.raw
  modified_base (471)..(471): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgtagagcgtcgtctgtcngtgaattgactactggggccagggaaccctggtcaccgtctcctcagcctccacc

SEQ ID NO: 534593 - DNA, 396 bp, Homo sapiens; identical to SEQ ID NO: 444469
  misc_feature: HEFZJCU01D1DA3.47.46.E02.1.454.heavy.3.raw

SEQ ID NO: 534594 - DNA, 516 bp, Homo sapiens
  misc_feature: HEFZJCU01BDKB8.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctggacgacacggctgtctattactgtgcgagagggcgtccgagtttaacacgccgtcggggagggatattactttgacaactggggccagggaaccctggtcaccgtctcctcagcctccaccaagggcccatcggtcttcccctggcgccctgcctccaggagcacctccgagagcacagccgcccgtcgggctgcctggtcaaggctaactt

SEQ ID NO: 534595 - DNA, 387 bp, Homo sapiens
  misc_feature: HEFZJCU01EDQRP.49.26.C04.1.454.heavy.3.raw
agtcgagagacacgaccggtgctcgatttagtctagcgactttgggtttgggggctgggaaaggacgccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggaggttcgtggtagagccgtggggggtccctgagactctcctgtgcaggcctctggacttcatctttgatgattatgccatgcacctgggatccggtcaagtcgtccgggggaagggttctggagtgggtactctcttattaattgggatgggtggtaatcacctacgtattgcag

SEQ ID NO: 534596 - DNA, 530 bp, Homo sapiens
  misc_feature: HEFZJCU01DECR2.8.82.H05.1.454.heavy.3.raw
ctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactgaggcgaagaagcccggggcctcagtgaaggtctcctgcaaggcgtccgggttacagtttcacaacgtatggtattagttgggtgcgacaggccccctggacaaggggcttgagtggatggggtggatcagcgccttcaactattacacaaactatgcacagaagttccgtgacagagtcaccatgaccatagacatttccacggacacagcctatatggagctgcggagcctgacatctgacgactcggccgtctagtttctgtgcgagaagaaatgggggatggtggggttggggccttattttgacttacgtggggccaggggaaccctggtcaccgtct

SEQ ID NO: 534597 - DNA, 512 bp, Homo sapiens
  misc_feature: HEFZJCU01DNEA0.52.78.H01.1.454.heavy.3.raw
  modified_base (475)..(475): a, c, t, g, unknown or other
cgcagtacgacacgaccggtgctcgatttagtgtgagtagtttgggtttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctcgtggggccgtggcaccctggtcactntcttctcagcctccaccaaggcccatcggtcttcccc

SEQ ID NO: 534598 - DNA, 499 bp, Homo sapiens
  misc_feature: HEFZJCU01CB75L.51.27.C05.1.454.heavy.3.raw
  modified_base (445)..(445): a, c, t, g, unknown or other
cgatcgtatacacgaccggtgctcgatttagacgcgatcgaagggtttggggctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagtaactatgcaatgcactgggtccgccaggctccaggcaaggggctggactgggtggcaggtatatcatatgatggaagcaataaatactacgcagactccgtgaagggccgattcaccatctccagagacagttccgatgacacagtctatctgcaaatgaacagcctgagngctgaggacacggtcttctttttactgtgtccgcgacggaagcaggtgcgtgga

SEQ ID NO: 534599 - DNA, 505 bp, Homo sapiens
  misc_feature: HEFZJCU01B9OPN.4.25.C03.1.454.heavy.3.raw
  modified_base (438)..(438): a, c, t, g, unknown or other
agcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctcccagagacaattccaacaacacgctgtttctgcaaatgaanacgcctgagagcgaggacacggctgtgtatcactgtgtcagagatgccggacgggccggtttacccc

SEQ ID NO: 534600 - DNA, 501 bp, Homo sapiens
  misc_feature: HEFZJCU01AZ605.17.10.A10.1.454.heavy.3.raw
  modified_base (459)..(459): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtgggtgggtcagcggctttgacggtaaggcacagtatgcacgaagatgaagggcagagtcacgattaccacggaccacccccacgaacacagtctacatgcaactgacgagcctgagagctgacgacacggccgtctattactgtgcgagaatgttttcngtcatcgtacaatttgataggctctatggactggacttcgtc

SEQ ID NO: 534601 - DNA, 525 bp, Homo sapiens
  misc_feature: HEFZJCU01EOM9V.13.76.G10.1.454.heavy.3.raw
tcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtggaggggccgattcaccatctccagagacaattccaagaacacgctgtttcttcaaatgaacagcctgagagccgatgacacggccgtgtattactgtgcgagagatggggcccgacgaacgttacctacgtctatggacgtcgtggggccgaacgggaccg

SEQ ID NO: 534602 - DNA, 517 bp, Homo sapiens
  misc_feature: HEFZJCU01CZYNN.51.77.G11.1.454.heavy.3.raw
  modified_base (439)..(439): a, c, t, g, unknown or other
cgatcgtatacacgaccggtgctcgatttagctagtcactcaagggaaaggggtctgggagaggagcccagcactagaagtcggcggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatttcatatgatggaagtaaaatattctatgtagactccgtgaagggccgacgttcatcatctccagagacaattcccagaacaccctgtttctgcaatgcanagcctgagacctgaggacacggctgtgtattactagtgcgtaacttaatcacggtaaggactaacgggtcgtaccccc

SEQ ID NO: 534603 - DNA, 504 bp, Homo sapiens
  misc_feature: HEFZJCU01AN34J.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctcagggaaggggctggagtgggtctcagttattgaaacagaatggcactacatattattctgactccgtgaagggccggttcaccctctccagagacacttaccaacaacatcttgtatcttcacatgcacaatctgagagtcgacgacacggcccacctattattgtgcgcgacatgactacgctcaattcgtgggccg

SEQ ID NO: 534604 - DNA, 535 bp, Homo sapiens
  misc_feature: HEFZJCU01CYTCJ.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaagtaatggctgtgtttattgggggccagggagccctggtcacg

SEQ ID NO: 534605 - DNA, 499 bp, Homo sapiens
  misc_feature: HEFZJCU01CMCYJ.48.27.C05.1.454.heavy.3.raw
agtatacatacacgaccggtgctcgatttagacgcgatcgaagggtttggggagctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccgagggaagggtctagagtggatttcatacattaggagtggcagtagtcccatatactacgcagactctgtgaagggccgattcatcatctccagagacaatgccgagaactcactgttctgcaatgaacagcctgagagacgaggacacggctgttattactgtgcgagagtgcggatttcacctacac

SEQ ID NO: 534606 - DNA, 518 bp, Homo sapiens
  misc_feature: HEFZJCU01CTGYT.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgaccacggaccatatattactgtgacgaaagcaccggcagttagtcacccatacctactttgacttacgtcggggaccg

SEQ ID NO: 534607 - DNA, 511 bp, Homo sapiens
  misc_feature: HEFZJCU01CGNYZ.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaaagagaatgattcagagaactcactttatctgcaaaatgaacagcctgagaaccgacgacacggccgtctattattgtgtcatagacctaggactacaacgac

SEQ ID NO: 534608 - DNA, 492 bp, Homo sapiens
  misc_feature: HEFZJCU01C0TO6.53.73.G07.1.454.heavy.3.raw
cgcgtatacacacgaccggtgctcgatttagctctacgctcagggggcatcatccaacaaccacatcccttctctacagaagcctctgagaggaaagttcttcaccatggactggacctggagggtcttctgcttgctggcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgagtggatgggtctaatcaaccctagtggtggatctacaagttactcacagagaatgcagggccgaattaccatgaccagagacacgtccacgagtacagtctacatggaggtgagcagcctgagatctgaggacacggccatgtattactggtgcgatcttagtggattacgactacaattattttgtctacg

SEQ ID NO: 534609 - DNA, 509 bp, Homo sapiens
  misc_feature: HEFZJCU01BJYPK.52.53.E09.1.454.heavy.3.raw
cgcagtacgacacgaccggtgctcgatttagagagagtgtgttgggtttgggagatcatgagggtgtccctgagactctcctgtgcagcctctggattcagctttgatgagtatgccatgcactgggtccggcaggctccagggaagggcctggagtgggtctcaggtattagttggactagtggtagtataggctatggggcctctgtgaagggccgattcaccatctccagagacaacgccaagaactccctgtctctgcaaatgaacggactgagagttgaggacacgggcttctactattgtgcaaaggcctgcccttttctatgatatcactgcttattactacacgccggttgactcctggggccagggaaccctggtcaccgtctcctcagcctccaccaacgggcccatcggtcttccccctggccaccctcctccaagagcacctctgggggcacagcggccctgggctgcctggtcaaggactacttcctatacgatcg

SEQ ID NO: 534610 - DNA, 527 bp, Homo sapiens
  misc_feature: HEFZJCU01D6OUC.48.54.E10.1.454.heavy.3.raw
agtatacatacacgaccggtgctcgatttagatcgtagcagaacacacaaaggggtctgagagaagagcccagccctgggattttcaggtgttttcatttggtgatcaggactgaacagagagaactcaccatggagtttgggctgaggtggctttttcttgtggcgattttaagaggtgtccagtgtgaggtgaagttgttggagtctgggggaggcttggtaaagccggggggctccctgacactctcctgtgtaacctctggcttcgactttaagtcttatgccatgacctgggtccgccaggctccagggaaggggctggagtgggtctcaacaattagtgttagtggtgacgacagatactacgcagactccgtggagggccgcttcaccatctccagagacagcccaagaacacactgtctctggagatgatcaacctgagagccgacgacacggcagtgtattactgcgcgaaagaaatcaagtgggctcatctcgggcggcccgacccactcggggccg

SEQ ID NO: 534611 - DNA, 485 bp, Homo sapiens
  misc_feature: HEFZJCU01BMIBB.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaattatgcaccatctgttgagagtcgactgacaatcaacgtagacacatcgaagaaccagttctccctgcagctgacctctgtgactccgacggacgacgggtgtatacttactgtggaagacggccccagtacg

SEQ ID NO: 534612 - DNA, 525 bp, Homo sapiens
  misc_feature: HEFZJCU01A3HLY.22.41.D08.1.454.heavy.3.raw
acatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgtttgggtgcgacaggcccctggacaacggcctgagtggatgggatggatgaacccttctaagggaaacacaaactatgcagagaggctccagggcagagtcaccatgaccgcagacacaccaacgaccacagcctacatggagttgaggagtctgagacctgacgacacggccgtatattactgcgcgagagggcgtttcgtacgggtgactatgagtatctcaggcacgtgggggccacgggcacccgtggtctacg

SEQ ID NO: 534613 - DNA, 505 bp, Homo sapiens
  misc_feature: HEFZJCU01BL82P.10.26.C04.1.454.heavy.3.raw
catagtagtgcacgaccggtgctcgatttagtctagcgactttgggtttggggggaaaaggaagactgacggtcccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggccccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacgttgacgacgaccggccgtatattactgtgcgagatcgaagaagg

SEQ ID NO: 534614 - DNA, 508 bp, Homo sapiens
  misc_feature: HEFZJCU01BECGG.12.30.C08.1.454.heavy.3.raw
atacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtccccagggaagggcctggagtggattgggtacatctatcacagtgggagcacctactacatcccgtccctgaagagtcgaattacgatgtcagtaaacacgtctaggaaccagttctccctgaagctgaggtctgtgactgccgcgagacacggccgtctactactgtgccaggtgggctttgcgccagtggttcagagatgatcgcttcgattcgtggggccagggaattcg

SEQ ID NO: 534615 - DNA, 514 bp, Homo sapiens; identical to SEQ ID NO: 495148
  misc_feature: HEFZJCU01D3J3E.22.82.H05.1.454.heavy.3.raw

SEQ ID NO: 534616 - DNA, 505 bp, Homo sapiens
  misc_feature: HEFZJCU01A39L9.17.33.C11.1.454.heavy.3.raw
  modified_base (485)..(485): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcgactacagtccgtctctgaagaacaggctcaccatcaccaaggacacctccacaaaccaggtggtccttacaatgaccaatatggaccctgtggacacagccacatattactgttcacgctctatggttcggggattattagtccccatttgactactggggccagggaactcgtggtcnccgtctccgcagcctccacc

SEQ ID NO: 534617 - DNA, 518 bp, Homo sapiens
  misc_feature: HEFZJCU01CT76Q.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcggagggggccgggatattgttatagaaccacctgctatctgagctggttcgactgctgggggccaggggaacccctgggtcctaccg

SEQ ID NO: 534618 - DNA, 399 bp, Homo sapiens; identical to SEQ ID NO: 444537
  misc_feature: HEFZJCU01DWWLN.16.29.C07.1.454.heavy.3.raw

SEQ ID NO: 534619 - DNA, 349 bp, Homo sapiens
  misc_feature: HEFZJCU01A5Y3K.18.78.H01.1.454.heavy.3.raw
tacgagtatgcacgaccggtgctcgatttagtgtgagtagtttgggtttgggctgggagaggagctaccagccttgggattccagctgtctccactcggttgatcggcactgaatacaggagactcaccgatggagtttgggcgtgaggctggggttttccttcgttggctattttaaaaggtgtcctaagtgttgaggttagccagcgtggtcggaggtccggggacggctcggtccgagcctggggggtccctgaaacgtctcctgtgcagcctcgtgggttcaccttcagtggctctgctatgcactggtccgcaggcttccgggaaaggctggagtggtggccgt

SEQ ID NO: 534620 - DNA, 525 bp, Homo sapiens
  misc_feature: HEFZJCU01EGE49.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtaggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggggccgggaaccctggtcgccgtctcctcagcctccaccaaggccatcggtcttcccctggccaccctcctccaagagcacctcgtgggggcacacgcggccctgggctgcctggtcgaaggacctaccttcaacgacgtagtca

SEQ ID NO: 534621 - DNA, 505 bp, Homo sapiens
  misc_feature: HEFZJCU01D3M8D.17.10.A10.1.454.heavy.3.raw
  modified_base (447)..(447): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgggatatatcttcacaaaatatggtatgaattgggtgcgacaggcccccggacaagggcttgagtgggtggggtgggtcagcggctttgacggtaagcacagtatgcaccgaagatgaagggcagagtcacgattaccacggacacccccacgaacacagtctacatgcaactgacgagcctgagagctgacgacacggccgtctattactgtgngagaatgttttctgtcatcgactaattgataggcttctatggtaactggactttcgtc

SEQ ID NO: 534622 - DNA, 515 bp, Homo sapiens
  misc_feature: HEFZJCU01BZ2YD.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataacagtctgagacttgaggacacggctgtctattactgtgcgagagactacggtgaccttttctggtatttcgatctctggggccgtggcaccctggtcactgtctcctcggcttccaccgaggcccatcggtccttccccctcggccgccctcgctccgaggagcaccgtccgtgggggtccacg

SEQ ID NO: 534623 - DNA, 556 bp, Homo sapiens
  misc_feature: HEFZJCU01CNH2H.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtacccacatactacacagactccgtgaagggccgattcaccatctcagaagacaattccaggaacacattgtatcttcaaatgaataacctgagagccgaggacacggccagtgtattactgtgttgggggctatttacttgacccccgtcgggggacccggggggaaccccgtcgggtactacccggtcctcccccacccctccaacccgg

SEQ ID NO: 534624 - DNA, 503 bp, Homo sapiens
  misc_feature: HEFZJCU01CH1NV.40.7.A07.1.454.heavy.3.raw
  modified_base (468)..(468): a, c, t, g, unknown or other
tctagcgactcacgaccggtgctcgatttagcacgtgtcgcaggggacccaacaaccacatccctcctcagaagcccccagagcacaactccttaccatggactggacctggaggatcctctttttggtggcagcagccacaggtgtccactcccaggtccagcttgtgcagtctggggctgaggtgaagaagcctggggcctcagtgaaggtttcctgcacggcttctggatacaccttcactagatatgctatacattgggtgcgccaggcccccggacaaagacttgagtggatgggatggatccaccctggcaattataacacaaaacattcacagaagttccagggcaggagtcaccattaccagggacacatccgcgagcacagtctacatggagctgagcagcctgagactctgaagacacggctgtgtattactgtgcgacgaatagtggctggcgaagnggtgggatactactttgactttcgtgggggccaac

SEQ ID NO: 534625 - DNA, 510 bp, Homo sapiens
  misc_feature: HEFZJCU01C6JVZ.13.36.D03.1.454.heavy.3.raw
tcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtggttcttcagtggttactactggagctggatccgccagtccccagggaaggggctggagtggattgggggaaatcgaatcatagtggaagcaccaactacaacccgtccctcgagagccgagtcaccatgtcagtagacacgtccaagaaccagttctccctgagggtgagctctgtgaccgcgcgacacggctgtgtacttctgtgcgagaggcaattttgactcgtcattctccctttgacttcgtgggccaggaaccctagtcaccgtcg

SEQ ID NO: 534626 - DNA, 521 bp, Homo sapiens
  misc_feature: HEFZJCU01AD0C3.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaaagacacgggcgtgtatttttgtgtgaaagatacgaagtctatgataccaatttggggagggcctttcat

SEQ ID NO: 534627 - DNA, 487 bp, Homo sapiens
  misc_feature: HEFZJCU01BWNG5.16.67.G01.1.454.heavy.3.raw
tgtactactccacgaccggtgctcgatttagagtatacatattgggtccctgagactctcctgtgcgacctctggattcacctttagcagctatgccatgagctgggtccgccaggctccagggaaggggctggagtgggtctcaactattagtggtagtggtggtaccacatacttcgctgactccgtgaagggccggttctccatctccagagacacttccaagaacacggtgtatctgcaagtgcacagcctgagagccgaggacacggccatatattactgtgcgaagatcgattccccctccgtagagatggctacaaaatctttctccgaattgacttctggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 534628 - DNA, 492 bp, Homo sapiens
  misc_feature: HEFZJCU01DK5C4.53.34.D01.1.454.heavy.3.raw
cgcgtatacacacgaccggtgctcgatttagatcgtctgtgttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcaagggcagggtctccatgaccagggacagggccagtcagaacagcctacatggagctgaacagactgacatctgacgacacggccgtttattatgtgtcggtagaggacggacccgat

SEQ ID NO: 534629 - DNA, 532 bp, Homo sapiens
  misc_feature: HEFZJCU01CZON4.53.64.F09.1.454.heavy.3.raw
  modified_base (490)..(490): a, c, t, g, unknown or other
cgcgtatacacacgaccggtgctcgatttagcgcgtatacaaggggtctgagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcggggggaggcttggtacagccgggggggtccctgagactctcctgtagagtctctggcttcacctttagagtctatgacatgagttgggtccgccaggctccggggaagggctggagtgggtctcaacgatcagtgatagcggaagtaccacaaactacgccgcctccgtgaagggccgatgcaccgtctccagagacaaattccgaaaggacacttttatatctgcaactcaacagactgacaaccgctgacacggccgtctattactgttgtcaaagaagacggaccgntggacgaggacgccagaaggaaaatcactactttgactactc

SEQ ID NO: 534630 - DNA, 498 bp, Homo sapiens
  misc_feature: HEFZJCU01B0TFB.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgattgccttcggtccgcgggtacttcgt

SEQ ID NO: 534631 - DNA, 536 bp, Homo sapiens
  misc_feature: HEFZJCU01EOZNZ.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggatttttcactcagtagtactggagaggctgtgggctggggtccgtcagcccccaggaaaggccctgggagtggcttgcactcatttattgggatgatgtgaagtactacagtccatatttcaagtaggctcactatcaccaaggacacttccaaaaaccagtaggtcctgacaatgaccaacgtgaagcctgcggacacggccacatattattgtgcacaccgacgcctataccgccagctgggaaatcgaccaactggttcgaccccgtcgggggccaggggaacccttgtccaccgtctcctctacggcctcccaccaacgggccctacg

SEQ ID NO: 534632 - DNA, 513 bp, Homo sapiens
  misc_feature: HEFZJCU01AZMVJ.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcgagggggctggaggtggggtggcagttatttcatatgatggaaatagtgacttctattcagactccgtgaagggccgattccaccgtctccagagacaattccaggcacacgctgtatctgcaatgaacagcctgagagctggaggacacggctgtgtatttactgttgaggaaacgtattttcctataggtaggtgaacgtac

SEQ ID NO: 534633 - DNA, 528 bp, Homo sapiens
  misc_feature: HEFZJCU01DM1X2.12.40.D07.1.454.heavy.3.raw
  modified_base (509)..(509): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgagggggccgattcaccatctccagagacaattacaagaacaccctttatctgcaaatagacagcctgagaccagacgacacggctgtctattattgcgcgagagagacacacgaacctactggccaatactatgggggcttggttctgggggccaggggaccctggtcatcgtctccccacgcctccaccaagggcccancggtccttccccctggccg

SEQ ID NO: 534634 - DNA, 520 bp, Homo sapiens
  misc_feature: HEFZJCU01BV2HX.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagtattttggagttggttactgtttgggacttacttttgaccttacgtgggggtcgtaggggaacccc

SEQ ID NO: 534635 - DNA, 507 bp, Homo sapiens
  misc_feature: HEFZJCU01DL2PL.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgaggagcctgacatctgacgacacggccgtctattactgtgcgagacgtcccacgatccgggtgagcctacggcagcggcctttgacttcgtc

SEQ ID NO: 534636 - DNA, 515 bp, Homo sapiens
  misc_feature: HEFZJCU01DMR9C.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccttcaccgacgaccatatatactgggtgcgacaggcccctggacaaggccttgagtggatgggacatatcagccctgtcagtggtgccacaaagtttgcacagaaactttcaggacagggtcaccatgaccacggacacgtccatcaacacagcctacatggaactgagagctaagatctgacgacacggccgtttattagttgtgcgaaataaagaatttagcaaacgatcgtctttttgataatggtggggccaaggggactacg

SEQ ID NO: 534637 - DNA, 513 bp, Homo sapiens
  misc_feature: HEFZJCU01EAJP9.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccggaggacacggctggtgtattactgtgacgtaggttttggttggggcgggatagcgagccggggtaccc

SEQ ID NO: 534638 - DNA, 521 bp, Homo sapiens
  misc_feature: HEFZJCU01BS1PP.48.38.D05.1.454.heavy.3.raw
agtatacatacacgaccggtgctcgatttagtatctgatagttgggtttgggggctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggccttggatccgccagccccccgggaagggactggaatggattgggagtatctattatacagggagcacctatacaacccgtccctcaagagtcgagtcaccatcctccgcagacacgtccaagaaccagttctccctgaggctgagctctgtgccgccgcagacacggctgtctattactgtgcgagaagtgggtcgtggcaggtgcgtggtacgtggctctcagtggttcgaccccgtggggccaggggactacgtcggtctaccg

SEQ ID NO: 534639 - DNA, 521 bp, Homo sapiens
  misc_feature: HEFZJCU01C66GQ.52.34.D01.1.454.heavy.3.raw
  modified_base (472)..(472): a, c, t, g, unknown or other
cgcagtacgacacgaccggtgctcgatttagatcgtctgtgttgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggatacccccataaccgggctactacttacactgggtgcgacaggcccctggacaagggcttgagtggatggggtggaacaatcccaacagtggaggcgaccggtcgcacagaatatgtgcggaagtttcagggcagggtcaccatgaccagcgacaggtccactaacacagcctacatggagctaagtagactgacatcctgacgacaacggccgtcgtaattnttgtgtaggagagagggacccgtatggacctcgaaccagtcgggacgtc

SEQ ID NO: 534640 - DNA, 510 bp, Homo sapiens
  misc_feature: HEFZJCU01D39AO.51.24.C02.1.454.heavy.3.raw
cgatcgtatacacgaccggtgctcgatttagtacagatcgttagggaaagggggggagacgagcccagcactcgaagtcgccggtgtttccattcggtgatcatcactgaacacagaggactcaccatggagtttgggctgagctgggttttcctcgttgctcttttaagaggtgtccagtgtcaggtgcggctggtggagtctgggggaggcgtggtccagcctggggattccctgagaatctcctgtgcagcctctggattcaacttcaatagacatcctatgcactgggtccgccaggctccaggcaaggggctggaatgggtgcagttattcgtccactggaaacagtaaacattatggacgctccgtgaagggcccattcgccatctccagagacaattccaaaaataccctctatctgcgaatgaacagcctgcgacctgaagacacggctatatactttctgtgcgaggaggggagtcttattgtaatgattggttcctgcta

SEQ ID NO: 534641 - DNA, 507 bp, Homo sapiens
  misc_feature: HEFZJCU01C59IU.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaacctcctccataaaacacagcctacatggagttgaggagcctgactatcgtgacgacacggccgtctaattctgtgcagagtcccagatccggtgaagcctacggcaggcgcctttgacttctc

SEQ ID NO: 534642 - DNA, 523 bp, Homo sapiens
  misc_feature: HEFZJCU01A5URM.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtattttgtagttgaaagatacgaagtctatgatacccaatttgggaggggcctttcact

SEQ ID NO: 534643 - DNA, 540 bp, Homo sapiens
  misc_feature: HEFZJCU01E1BC4.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcgttatctgcagataaccaaccttcaacctgacgacactgccgtttattttgttacgagagcgtcgtctgtcagtgaattgactactggggccagggaacccgtggtccaccgtctcctcacgcctccaccaacgggaccc

SEQ ID NO: 534644 - DNA, 529 bp, Homo sapiens
  misc_feature: HEFZJCU01BZX6H.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatggggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacgaatgaccaatatggaccctgtggacacagccacatattactgttcacgctctatggttcggggagttattagtccctactttgacctacgtggggccgagggaactctggtcaccgtcctccgtcagccctccacccaaggggccccattcc

SEQ ID NO: 534645 - DNA, 508 bp, Homo sapiens
  misc_feature: HEFZJCU01BOPS3.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacctaacactggtgtcacagtgtcttcacccatcctccgggacagacttaccatgaccacgaactcctccataaacacagcctacatggagtttgaggagcctgacatctgacgacacggccgtctattactgtgcgagagtcccacgatccgggtgacgcctacggcaggcggcctttggacttcgtc

SEQ ID NO: 534646 - DNA, 525 bp, Homo sapiens
  misc_feature: HEFZJCU01AQWBY.49.35.D02.1.454.heavy.3.raw
agtcgagagacacgaccggtgctcgatttagcacacgatagttgggtttgggctgagctgggttttccttgttgctattttaaaaggtgtccagtgtgacgtgcaggtggtggagtctggggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactgggccagggaaccctggtcaccgtctcctcagcctccaccaagggcccatcggtcttcccctggcgccctgctccaggagcacctccgagagcacagcc

SEQ ID NO: 534647 - DNA, 549 bp, Homo sapiens
  misc_feature: HEFZJCU01A62S9.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgtagttttacgtggactctgtgaagggccgtttcaccatctccagagacaacgccaagaattcactgtatctacaactgacagcctgagagtcgcagacacggccgtgtattactgtgcgagatgtaggaaaaagtaagtggctgttgttttagttgggggccaggggacgcccgttcggtactacccg

SEQ ID NO: 534648 - DNA, 507 bp, Homo sapiens
  misc_feature: HEFZJCU01EXWHQ.48.35.D02.1.454.heavy.3.raw
  modified_base (476)..(476): a, c, t, g, unknown or other
agtatacatacacgaccggtgctcgatttagcacacgatagttgggtttggggatgctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctcncagtggttcgaccctgggccaggactacgtc

SEQ ID NO: 534649 - DNA, 485 bp, Homo sapiens
  misc_feature: HEFZJCU01ESLLJ.8.39.D06.1.454.heavy.3.raw
ctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagatcaacccgagtggaggtggtgcagagtacgcccagaggtttcagggcagagtctccatgaccagtgacacgtccgcgagcactgtctatatggagatgaggagcctgagtacttgacgacacggccgtatattactgtgcgagaatcggaagaaggtggctac

SEQ ID NO: 534650 - DNA, 514 bp, Homo sapiens; identical to SEQ ID NO: 446900
  misc_feature: HEFZJCU01E1FL3.10.53.E09.1.454.heavy.3.raw

SEQ ID NO: 534651 - DNA, 523 bp, Homo sapiens
  misc_feature: HEFZJCU01CZCBT.17.33.C11.1.454.heavy.3.raw
  modified_base (497)..(497): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagtttattagtcccttactttgactactggggccagggaactctggtcaccgtctccgnacgcctccaccaacgggccccattcc

SEQ ID NO: 534652 - DNA, 535 bp, Homo sapiens
  misc_feature: HEFZJCU01DLDHR.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctgggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgcccgttttatttttgtacgagagcgtcgtctgtcagtggaattgactactggggccagggaaccctggtcaccgtctcctcagcctccaccaaggg

SEQ ID NO: 534653 - DNA, 542 bp, Homo sapiens
  misc_feature: HEFZJCU01EP1TC.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtgcagcagctacaggtgtccagtcccaggtccagttggtgcaatctggggctgaggtgaagacgcctgggtcctcggtgagggtctcctgcaaggtcttctggaggcacctttcagcgactatagtttcaattgggtgcgacgggcctctggacaaggccttgagtggatgggaaggatcgtcctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgtcttcctttttaccaaccttccctttgtaccttctcggggccagtcggaaccccggtaccg

SEQ ID NO: 534654 - DNA, 533 bp, Homo sapiens
  misc_feature: HEFZJCU01AIT22.17.28.C06.1.454.heavy.3.raw
  modified_base (522)..(522): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaagtatggctgtgtttagtggggccagggacnccgtggtcacg

SEQ ID NO: 534655 - DNA, 530 bp, Homo sapiens
  misc_feature: HEFZJCU01AP7OR.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacacacggccgtctattactgtcgcgagacgtcccacgatcccgggtgacggcccttacgggcaaggccggtccttttagacctttcgtggggcccagggggtaccg

SEQ ID NO: 534656 - DNA, 507 bp, Homo sapiens
  misc_feature: HEFZJCU01DQD74.47.48.E04.1.454.heavy.3.raw
  modified_base (463)..(463): a, c, t, g, unknown or other
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatggacagcctgagagtcgaagacacggctgtntattactgtgtgtctctgacgtcctcggccgaccttggctttcg

SEQ ID NO: 534657 - DNA, 498 bp, Homo sapiens
  misc_feature: HEFZJCU01AWI0B.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagagtggaggtcgattattgta

SEQ ID NO: 534658 - DNA, 542 bp, Homo sapiens
  misc_feature: HEFZJCU01C4IAP.19.10.A10.1.454.heavy.3.raw
  modified_base (479)..(479): a, c, t, g, unknown or other
tactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccagggaagggctggagtgggttggccgcatcaagaggagataatgaaggggaggcgacagactacgctgcacccgtgagaggcagatttaccatgtcaagagatgattcacaaagtacagtgtatctgcaaatgaacagcctgaagaccgaggacacagccatttactattgtaacaaatnaatactgggggaacggggggaaaagttggggccaagggaaccctggtcctccgtctcgtcagt

SEQ ID NO: 534659 - DNA, 536 bp, Homo sapiens
  misc_feature: HEFZJCU01CG3FC.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctgggagtgggtggccaacataaagcaagatggaactgccgagttttacgtggactctgtgaagggccgtttcaccatctccagagacaacgccaagaattcactgtatctacaactgacagcctgagagtcgcagacacggccgtgtattactgtgcgagatgtggaaaaagtaatggctgtgtttattggggccagggagccctggtctaccg

SEQ ID NO: 534660 - DNA, 536 bp, Homo sapiens
  misc_feature: HEFZJCU01C5QD6.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggaacaaattaacgaacacagttaatctggagctgaacagcctgtcatctgaggacacgggcttctacttctgtgcgaggagtaattatataacactgctccttttacacctcccttgacctttcgtgggggccagtacggaaccccggtccg

SEQ ID NO: 534661 - DNA, 548 bp, Homo sapiens
  misc_feature: HEFZJCU01C1Y8T.12.79.H02.1.454.heavy.3.raw
  modified_base (202)..(202): a, c, t, g, unknown or other
  modified_base (444)..(444): a, c, t, g, unknown or other
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggancctggggcctcagtaaaatctcctgcaagtcttctggttacgcactcaccgccaatggtatcagctggctgcgacaggcccctggacaaggtcttgagtggatgtcatggatcagcactttcaatggagacacaaagtatggagagaacttccagggcagagtcaccatgaccactgacagatcaacgaacatagcctacttggaactgagggcctgaggtctggacgacacgggccccttntactttattgtggtaccggagtaaactttaaattttttccggtttaatttggtttccttgggttggtgttggttgtttacctaaattgttttggacctagtttc

SEQ ID NO: 534662 - DNA, 514 bp, Homo sapiens
  misc_feature: HEFZJCU01DM4OS.13.76.G10.1.454.heavy.3.raw
tcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccagggaaggggctggagtgcgtctcttttatttatagtagtggtagtacatactccgcagactccgtgagggggccgattcaccatcctccagagacaattccaagaacacgctgtttcttcaaatgaacagcctgagagccgatgacacggccgtgtattactgtgcgagagagtggggcccacgaacgttactacgctatggacgtcgtggggccaa

SEQ ID NO: 534663 - DNA, 508 bp, Homo sapiens
  misc_feature: HEFZJCU01BMFAR.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagctacatggagttgaggagcctgacatctgacgacacggccgtctattactgtgcgagagtcccacgatccggtgacgcctacggcaggcggccttttggactttcgtc

SEQ ID NO: 534664 - DNA, 542 bp, Homo sapiens
  misc_feature: HEFZJCU01EZKS2.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctggaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagaccaagacagtattttggagttggttacttggttggtaccttacgtttagaccgttacgtcgggggtaccgaacggggtaacccctgggttacccg

SEQ ID NO: 534665 - DNA, 413 bp, Homo sapiens; identical to SEQ ID NO: 452062
  misc_feature: HEFZJCU01AVDGB.40.81.H04.1.454.heavy.3.raw

SEQ ID NO: 534666 - DNA, 499 bp, Homo sapiens
  misc_feature: HEFZJCU01DUN4V.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggccccctgacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacgacggccgtctattactgtgcgagaattgtttctgtcatcgtacatttgataggctctatggactggacttc

SEQ ID NO: 534667 - DNA, 394 bp, Homo sapiens
  misc_feature: HEFZJCU01B7JMC.47.42.D09.1.454.heavy.3.raw
agctcacgtacacgaccggtgctcgatttagacacatacgcagggaaaggggctggagtgggtctcaagtattgatgagaatggtggaagcacattctacgtggactccgtgaagggccggttcaccatctccagagacaattttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctgtcaggactcttcctacgtgagct

SEQ ID NO: 534668 - DNA, 490 bp, Homo sapiens
  misc_feature: HEFZJCU01C74XV.12.75.G09.1.454.heavy.3.raw
  modified_base (438)..(438): a, c, t, g, unknown or other
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaaggggcttgagtggatggggaggagtcatccctctctttcgttcagcagactacgcacagaaattccaggacagagtcacgattaccgcggacgaatccacgaccacagcctacgactagagctgcgcagcctgagatctgaagacncggcactttattactgtgcgagagagtgcacgggcctcccacactcggttta

SEQ ID NO: 534669 - DNA, 509 bp, Homo sapiens
  misc_feature: HEFZJCU01BTLWC.48.12.B01.1.454.heavy.3.raw
agtatacatacacgaccggtgctcgatttagtagtgtagattccgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttacgtactgtgcgcggggagtggacggagctcggtttcggagttatcatctactactttgaattc

SEQ ID NO: 534670 - DNA, 520 bp, Homo sapiens
  misc_feature: HEFZJCU01EN2ED.16.2.A02.1.454.heavy.3.raw
tgtactactccacgaccggtgctcgatttagactcatctacagggggagagaggagccttagccctggattccaaggcctatccacttggtgatcagcactgaccaccgaggattcaccatggagctggggctccgctgggttttccttgttgctattttagaaggtgtccagagtgaggtgcagctggtggagtttgggggaggcctggtcaagcctggggggtccctgagactctcctgtgcagcctctgaattcatcttcagtatctataacatgaactgggtccgccagactccagggaaggggctggagtgggtcgcatccattagtggtggtaataattacatatactacggagactcaatgaaggccgcttcaccatctccagagacaacgccgaaaactcactgtatctgcagatgaacagcctgagagccgaagacacggctgtgtattactgtgcgaggaggtcttactattaggttcgggggagtttaatataacgacgttatttacgt

SEQ ID NO: 534671 - DNA, 513 bp, Homo sapiens
  misc_feature: HEFZJCU01BW7I6.4.67.G01.1.454.heavy.3.raw
  modified_base (484)..(484): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccggggggtccctgagactctcctgtgcagcctctggattcagttttagaatgtctgccatgacctgggtccgccaggctcctgggaagggctggagtggatctcagggattagtggcactgggcgtattatacatattatacagactccgtgaagggccgcttcaccatctccagagacaattccaagaacacggtgtatctgcaaatgaacagcctgagagcgaggacacgggccacgatattactgtgacgaaagntctcgggctcgggttccgcgggtccgggt

SEQ ID NO: 534672 - DNA, 529 bp, Homo sapiens
  misc_feature: HEFZJCU01EFNNA.17.25.C03.1.454.heavy.3.raw
  modified_base (407)..(407): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtattcaactgggtgcgccaggccgctggacaacgacctgagtggatgggatgggcgaaccctaacactggtgtcacagtgtcttcacccatccctccgggacagacttaccatgaccacgaactcctccataaacacagcctanactggagttgaggagcctgacatctgacgacacggccgtactacttactgtgcgagagtccccacggtatccgggttggacgcccgtaacggcctaggccgggccttttgaacctttcgtcc

SEQ ID NO: 534673 - DNA, 508 bp, Homo sapiens
  misc_feature: HEFZJCU01BGTEU.51.54.E10.1.454.heavy.3.raw
cgatcgtatacacgaccggtgctcgatttagatcgtagcagaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaaattatgcacaggagtttcggggcagggtcgtcatgaccggggacacgtccatcgccacgacttacatggaactgaccagtctgacatttgacgacacggccgtctattactgtgcgacagaagcggcggacagaggttcgcttactggttcgaggctcc

SEQ ID NO: 534674 - DNA, 506 bp, Homo sapiens; identical to SEQ ID NO: 446520
  misc_feature: HEFZJCU01C8MY4.10.38.D05.1.454.heavy.3.raw

SEQ ID NO: 534675 - DNA, 531 bp, Homo sapiens
  misc_feature: HEFZJCU01AU612.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactatacactgcttccttttacaccttcccttgtacttctgggccatcggaacccggtaccg

SEQ ID NO: 534676 - DNA, 501 bp, Homo sapiens
  misc_feature: HEFZJCU01D0NC4.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggatggacttcgtc

SEQ ID NO: 534677 - DNA, 518 bp, Homo sapiens
  misc_feature: HEFZJCU01DFRYE.48.37.D04.1.454.heavy.3.raw
agtatacatacacgaccggtgctcgatttagtagcatactgttgggtttgggggggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagttttaacacgccgtcggggagggagtatttacg

SEQ ID NO: 534678 - DNA, 510 bp, Homo sapiens
  misc_feature: HEFZJCU01CWEX6.49.27.C05.1.454.heavy.3.raw
agtcgagagacacgaccggtgctcgatttagacgcgatcgaagggtttggggacccaacaaccacatccctcctcagaagcccccagagcacaacgcctcaccatggactggacctggaggatcctctttttggtggcagcagccacaggtgcccactcccaggtccaacttgtgcagtctggggctgagttgaagaagcctggggcctcagtgaaggtttcctgcacggtttctggataccccctcagcagtcatgctatgcattgggtgcgccaggcccccggacaaaggtttgagtggatgggatggatcaccgctggcaatggtgacacaaaatattcacaaaagttccagggcagagtcaccatttacagggacacatctgcgagttcaggctacatggaactgagcggcctgagatatgaggacacggctatttattactgtgcgagagggaatgggatattgtgtcagctccaggtgccagccggcccctactttcgactacg

SEQ ID NO: 534679 - DNA, 477 bp, Homo sapiens
  misc_feature: HEFZJCU01DXGQ3.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgagacacggctgtgttttactgtgcgagagaga

SEQ ID NO: 534680 - DNA, 499 bp, Homo sapiens
  misc_feature: HEFZJCU01EMC17.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacagtacttccgcagactccgtgaagggccggttctccatctccagagacaattccaaagaacacgctgtatctgcaattgaacagcctgagagccggaggacaccggccgtatattactgtgacgaaagatttggggaatgaccacgtc

SEQ ID NO: 534681 - DNA, 505 bp, Homo sapiens
  misc_feature: HEFZJCU01ET1XA.17.25.C03.1.454.heavy.3.raw
cgtagactagcacgaccggtgctcgatttagtagtgtagatttgggtttggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagtttgaggagcctgacatctgaccgacacggccgtctattactgtgcgagacgtcccacgatccggtgagcctacggcagcggt

SEQ ID NO: 534682 - DNA, 554 bp, Homo sapiens
  misc_feature: HEFZJCU01BX6RH.49.38.D05.1.454.heavy.3.raw
agtcgagagacacgaccggtgctcgatttagtatctgatagttgggtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtctttattacgtatgccagtgtctttacgtaccgtttccgtaccccgtcgggggccgaggggacggcccgttgggtccacccggtcctcccttcagtccttcccacccgaaacggggccccacgtccggtccctttcccccgttcgggccgtccccg

SEQ ID NO: 534683 - DNA, 528 bp, Homo sapiens
  misc_feature: HEFZJCU01EPW2B.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaatactatacactgctccttttacacctcccttgacttctggggccatcggaaccccggtccg

SEQ ID NO: 534684 - DNA, 546 bp, Homo sapiens
  misc_feature: HEFZJCU01A5KAR.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaaggcctggagtggattggatacatctattactttgggagcaacctactacaacccgtccctcaagagtcgagtaacgatctcagtggacacgtctaacaatcacctctccctgaggctgagctctgtgacagccgcggacacgggcgtttattactgtgcgaggaggggacggtacgtacgggtgacctacgttggggggttccgaccccgttggggggccctaaggggaaccccttgggtccaacccgttccgtccctccga

SEQ ID NO: 534685 - DNA, 529 bp, Homo sapiens
  misc_feature: HEFZJCU01AQ2QD.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactagtgggggcttgttctgggggccagggggaccctgggtcatcgtctccccagcctcccaccaacgggcccatcggtcttccccctggccg

SEQ ID NO: 534686 - DNA, 506 bp, Homo sapiens
  misc_feature: HEFZJCU01DEBS9.49.21.B10.1.454.heavy.3.raw
agtcgagagacacgaccggtgctcgatttagtgtcgtcgcaaggggctgggagacgagcccagcactggaaggcgccggtgtttccattcggtaatcagcactgaacacagaggactcaccatggagtttgggctgagctgggttttcctcgttggtcttttaagaggtgtccagtgttatgtgcagttggtggagtctgggggaggcgtggtccagcctgggaagtcactgagactcgcctgtacaccctctggattcaccttcagcaactatgcaatgcactgggtccgcctggctcccggcaagggtctggactgggtggcaggtatatcagctgatgggaccaaaatatactacgcaaactccgtgaagggccgattcaccatatcaagagacacttccgatgacacaatctatctgcaaatgaacagcctagaaagttgacgacacgggttcttttttactgtgcgcctggaagcagttggcgtggccacatgatgctttt

SEQ ID NO: 534687 - DNA, 499 bp, Homo sapiens; identical to SEQ ID NO: 456349
  misc_feature: HEFZJCU01B5XPU.11.71.G05.1.454.heavy.3.raw

SEQ ID NO: 534688 - DNA, 315 bp, Homo sapiens
  misc_feature: HEFZJCU01CVYM8.49.8.A08.1.454.heavy.3.raw
agtcgagagacacgaccggtgctcgatttagcatactctacagggggggagaggagccagcactagaagtcggcggtgtttccattcggtgatcagcactgaacacagaggactcaccatggagtttgggctgagctgggttttcctgttgctcttttaagaggtgtccaagtgtcaggtgcagctggtggagtctggggagcgtggtccagcctggagtcctgagactctcctgtgcagctctggattcacttcagggtctatgacactgcactgggtccgccaggctccaggcaagggcctggagtgggtggc

SEQ ID NO: 534689 - DNA, 503 bp, Homo sapiens
  misc_feature: HEFZJCU01EYCL6.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagccgtgggaggtccctgagactctcctgtacagcctctggcttcaccttcattacctatggcatgcactgggtccgccagactccaggcagggggctggaggtgggtggcagttatttcatatgatggaaatagtgacttctattcagactccgtgaagggccgattcaccgtctccagagacaattccaggcacacgctgtatctgcaaatgaacagcctgagagccgaggacacggaccgtatatttctgtgacgaaagatcgggcattatagtgcctacgaccgtggggt

SEQ ID NO: 534690 - DNA, 505 bp, Homo sapiens
  misc_feature: HEFZJCU01EANQL.12.79.H02.1.454.heavy.3.raw
  modified_base (493)..(493): a, c, t, g, unknown or other
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaatctcctgcaagtcttctggttacgcactcaccgccaatggtatcagctggctgcgacaggcccctggacaaggtcttgagtggatgtcatggatcagcactttcaatggagacacaaagtatggagagaacttccagggcagagtcaccatgaccactgacagatcaacgaacatagcctacttggaactgagggcctgaggtctgacgacacggccctctattattgtgcgagattaattttcgttattgttctggtggtgtgtgttcaatntttgacctattc

SEQ ID NO: 534691 - DNA, 526 bp, Homo sapiens
  misc_feature: HEFZJCU01CRZL6.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtcgtggggggggcttagtccagcctggggatccctaagactctcctgtgcagcctctggattcaactttggcaagtcttggatgggctgggtccgccaggctccagggaggcggctggagtgggtggccaacataaatgacgatggcaaaggagacctactatttggactctgtgaggggccgattcatcatctccagagacaacgccgacaactcactgtctctgctgatgagcagcctgagagccgacgacacggctatctattactgtgcgaaactctactattccgttcattctgaaattactgggggtccaggggaaacccctgggtccgtcccgg

SEQ ID NO: 534692 - DNA, 516 bp, Homo sapiens
  misc_feature: HEFZJCU01DQ50T.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgagtacggctgtctatctattgtgttttcgattgccttcggtccgcgggacttcgtggggccagggaacccgtc

SEQ ID NO: 534693 - DNA, 515 bp, Homo sapiens
  misc_feature: HEFZJCU01DTL2N.46.67.G01.1.454.heavy.3.raw
  modified_base (478)..(478): a, c, t, g, unknown or other
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagttttccctgacgctgacgtctgtgaccgccgcagacacggctgtctattattgtgcgagactagccttctagtagtggggtacttgcaaccggntactctccacttcggcttggacatcgtcgggccggac

SEQ ID NO: 534694 - DNA, 479 bp, Homo sapiens
  misc_feature: HEFZJCU01B4AGQ.19.71.G05.1.454.heavy.3.raw
  modified_base (371)..(371): a, c, t, g, unknown or other
  modified_base (398)..(398): a, c, t, g, unknown or other
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgngagtcgactgacaatcaacgtagacanatcgagaaccagttctccctgcagctgacctctgtgactcccgaggacacggtgtatattactgtggaagagccccatacg

SEQ ID NO: 534695 - DNA, 536 bp, Homo sapiens
  misc_feature: HEFZJCU01EBTTE.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccacgcctccaccaacgggcccatcggtccttccccctcggccgtcccgtcg

SEQ ID NO: 534696 - DNA, 516 bp, Homo sapiens
  misc_feature: HEFZJCU01DL7J3.51.31.C09.1.454.heavy.3.raw
cgatcgtatacacgaccggtgctcgatttagacgtctcatcaaggaaggaagggggctctgagagaggagcccagccctgggattttcaggtgttttcatgtggtgatcaggactgaacagagagaactcaccatggagtctgggctgacgtggctttttcttgtggctattttaaaggtgtccagtgtgacgtgcagctggtggagtctgggggaggcttgatacagccgggggggtccctgagactctcatgtagaacctctggcttcatgtttagagtctatgacatgagttgggtccgccaggctccggggaaggggctggagtgggtctcgaatgatcagtgatggtggaacgaccacaaactacgccgactccgtgaagggccggtgcaccatctccagagacaattcgaaggacactttatattctgcaactcaacagactgacacccgcggacacggccgtctactactgtgtagaaagagacggaccgctggacgaggagccagagg

SEQ ID NO: 534697 - DNA, 485 bp, Homo sapiens
  misc_feature: HEFZJCU01C1PUE.49.35.D02.1.454.heavy.3.raw
  modified_base (477)..(477): a, c, t, g, unknown or other
agtcgagagacacgaccggtgctcgatttagcacacgatagttgggtttggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctgggagtgggtggcagttatatcatatgatggaagcaagatatactatgtagactccgtgaagggccgattcatcatctccagagacaactccgagaacacgctgtatctgcaatgaacaggctgagagctgaagacacggctgtatattactgtcgngaacttaa

SEQ ID NO: 534698 - DNA, 498 bp, Homo sapiens
  misc_feature: HEFZJCU01EG3NU.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagacacgcagtatctgcaaaatgaaacagcctgagagctgaggacacggctgtgtattactggtgggagagagtggtaggtcgtatattgta

SEQ ID NO: 534699 - DNA, 505 bp, Homo sapiens
  misc_feature: HEFZJCU01CSKXX.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagacgtggccgcaacagactacggtggcaactcctatgtcttttgatatacgtggggccgaagggac

SEQ ID NO: 534700 - DNA, 414 bp, Homo sapiens
  misc_feature: HEFZJCU01BTAQC.51.62.F07.1.454.heavy.3.raw
cgatcgtatacacgaccggtgctcgatttagtagtcgcataaagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggccctgggctgcctggtcaggactacttcctcgtagcact

SEQ ID NO: 534701 - DNA, 534 bp, Homo sapiens
  misc_feature: HEFZJCU01AUN11.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgagggcctctggacaaggccttgagtggatgggaaggatcgtccctatcgttgacacaccaaactacgcacagaagttccagggcagactcaccataaccgcggacaaattaacgaacacagttaatctggagctgacagcctgtcatctgaggacacgggcttctacttctgtgcgaggagtaattactataacactgcttcctttttacaccttcccttgtaacttcgtggggccatcggaaccccggtccg

SEQ ID NO: 534702 - DNA, 539 bp, Homo sapiens
  misc_feature: HEFZJCU01BYCE5.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaattccaagccgcgggggtcacccaaattgactactggggccgagggaacccgtggtccaccgtcctcctcacgccgtccaccaacgggcccgatccggtccttcccccgtcggccgccctgcctccgac

SEQ ID NO: 534703 - DNA, 520 bp, Homo sapiens
  misc_feature: HEFZJCU01BQPOQ.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattccagcatctccagagacaacggcaagagtatactgtatctggaaatgaacaatctgagagtcgacgatacggctgtctatcattgtgttttcgatgccttcggtcccgcgggacctttcgtggggcctaggggtaacccg

SEQ ID NO: 534704 - DNA, 550 bp, Homo sapiens
  misc_feature: HEFZJCU01AICBG.13.26.C04.1.454.heavy.3.raw
tcacgtactacacgaccggtgctcgatttagtctagcgactttgggtttgggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacaggcacatccgcgaaacacagcctacatggaactgaggaatctgacatctgacgacacggccatatattactgtggcgaggaaggtacgggttttggggcgcggactcctcttgaggatcgtgggggccaggggggactaagtacggtcgtaccggttcctcgttctacg

SEQ ID NO: 534705 - DNA, 525 bp, Homo sapiens
  misc_feature: HEFZJCU01B2VLR.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaatattggtgggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgatatttggggcctaaggggaccaaggggtcaccgtctcccgctagcctcctaacc

SEQ ID NO: 534706 - DNA, 522 bp, Homo sapiens
  misc_feature: HEFZJCU01BDGZX.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcaggggtcaccatgacctgggacgcgtccatcagcacagtctacatggatctgagcggactggacctcgtcgacgacgacggccatagtattactgtaggtaagacgtacggttgggtggtcctaaccggcgggggctcggacctacgtcggggacc

SEQ ID NO: 534707 - DNA, 505 bp, Homo sapiens; identical to SEQ ID NO: 524126
  misc_feature: HEFZJCU01DT6LG.17.25.C03.1.454.heavy.3.raw

SEQ ID NO: 534708 - DNA, 492 bp, Homo sapiens
  misc_feature: HEFZJCU01EQWK6.40.42.D09.1.454.heavy.3.raw
tctagcgactcacgaccggtgctcgatttagacacatacgcagggaaaggggcatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaaccctggggcctcagtgaaggtttcctgcaaggcatctggatacaccttcaccaggtattttatgcactgggtgcgacaggccccgggacaaggggcttgagtggatgggcataatcaacccaagtggtggtagcacaacctacacacagaagttccagggcagagtcaccgtgaccagcgacacgtccacgactacagtctacatgcaactgagcagcctgaggtctgaggacacggccgtgtattactgtgcgagagatgatactagtgttattaacttaaatag

SEQ ID NO: 534709 - DNA, 517 bp, Homo sapiens
  misc_feature: HEFZJCU01B45MW.53.14.B03.1.454.heavy.3.raw
cgcgtatacacacgaccggtgctcgatttagtgtgagtagttccgcgggcctggcgcacccaatggatagcatgggtactgagggtgtatccagaagcctggcaggaaaccttcactgaggccccaggcttcttcgcctcagccccagactgcacaagctggacctgggagtgggcacctgtggctgctgccaccaaaagaggatcctccaggtccagtccatggtgaggcgttgtgctctgggggcttctgaggagggatgtggttgttgggtcagcgctggcaatggtgacagacactattcacagaagttccagggcagagtcaccatcaccagggacacatccgcgagcacagcctacatggaactgagcagcctgagatctgaagacacgggtgtatattactgtgcgagagggaagtgggatagttgtagatgccgccagggtcgcccggccggcccccttacgtttgaactcgtggggggcccggggtaaccctgggtaccaccgttccg

SEQ ID NO: 534710 - DNA, 504 bp, Homo sapiens
  misc_feature: HEFZJCU01EUFHL.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagtttgagcagcctgagatctgacgacacggccgtttattactgtgcgcgagataatagtacacaactggaacggtcgttttaggggtggttc

SEQ ID NO: 534711 - DNA, 482 bp, Homo sapiens
  misc_feature: HEFZJCU01E0Q12.53.56.F01.1.454.heavy.3.raw
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcagggtcaccatgaccagggacacgtccatcagcacagcctacatggagctacacggccctgagatctgacgacacggccctgtattttgtgcgagagagtctattaaagt

SEQ ID NO: 534712 - DNA, 503 bp, Homo sapiens
  misc_feature: HEFZJCU01DXDVG.48.67.G01.1.454.heavy.3.raw
agtatacatacacgaccggtgctcgatttagagtatacatattgggtttggggtctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtcccgtgacactgtccctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtcttattctgtgcgagagggcgtccgagtttaacacgccgt

SEQ ID NO: 534713 - DNA, 502 bp, Homo sapiens
  misc_feature: HEFZJCU01B6MQ5.17.10.A10.1.454.heavy.3.raw
  modified_base (464)..(464): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacaacagtctacatgcaactgacgagcctgagagctgacgacacggccgtctattactgtgcgagaatgttttctgtnatcgtacaattgataggctctatggactggacttcgtc

SEQ ID NO: 534714 - DNA, 519 bp, Homo sapiens
  misc_feature: HEFZJCU01D7FIL.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcaatgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaacctggtgaccgtctcctcagcctccaccaacgggcccatcggtcttcccctggccgccctcgctccaggagcacctccgagagcacagcgcc

SEQ ID NO: 534715 - DNA, 517 bp, Homo sapiens
  misc_feature: HEFZJCU01EP0OS.48.4.A04.1.454.heavy.3.raw
  modified_base (445)..(445): a, c, t, g, unknown or other
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggacgaagaaccagttctccctgaactgaccgctgtgaccgccgcggacacggctgtgtattactgtgcgagacgaatgggcggggnggtcgtacgtacttgacttttggggccacggggaaacctaggtctaccgtctccccagcttccaccgaacgg

SEQ ID NO: 534716 - DNA, 518 bp, Homo sapiens
  misc_feature: HEFZJCU01CCEMA.48.27.C05.1.454.heavy.3.raw
agtatacatacacgaccggtgctcgatttagacgcgatcgaagggtttggggctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtggtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacattccaagagcacggttcatctgcaaatgagcgccctgacgaccgtgacgacacggctgtctattactgtgcgaggagggcgtccggagtttaacacgccggtcgggagggattacg

SEQ ID NO: 534717 - DNA, 527 bp, Homo sapiens
  misc_feature: HEFZJCU01AIEBP.11.72.G06.1.454.heavy.3.raw
cgagagataccacgaccggtgctcgatttagctacgactgcaagggaaaggggacccaaaaaccacacccccccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggagcagagtctatgcggagagattccgagggcagagtcaccctgaccacagagacatccacgaccacagtctacatggagctgtggagcctgagacctgacgacacggccctctattactgtgcgaggccctatcctacagtgaccacttcccacgtctggtttccgaccgtcgtcgggggccacggggtaaccccg

SEQ ID NO: 534718 - DNA, 517 bp, Homo sapiens; identical to SEQ ID NO: 446891
  misc_feature: HEFZJCU01BQKTQ.17.33.C11.1.454.heavy.3.raw

SEQ ID NO: 534719 - DNA, 521 bp, Homo sapiens
  misc_feature: HEFZJCU01EOWH5.16.35.D02.1.454.heavy.3.raw
tgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctggggccaaggggacccg

SEQ ID NO: 534720 - DNA, 487 bp, Homo sapiens
  misc_feature: HEFZJCU01D89XX.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtcatcagcacagcctacagtggacctgagcggcctggacatctgacgacgacggccgtatactttcgtcgtgccggaggga

SEQ ID NO: 534721 - DNA, 529 bp, Homo sapiens
  misc_feature: HEFZJCU01C9L3N.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtacccacatactactccgaccccgtgaagggccgattaaccatcctccagagacgattccgagaacacggtgtatcttcaaatgaacaacctagagagccgacgacacggccgtttattactgtgcgagagattgagtggttcgggggacctccgtaccctggttctacttcgtatctctggggcc

SEQ ID NO: 534722 - DNA, 513 bp, Homo sapiens
  misc_feature: HEFZJCU01ARG1F.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaccaggtggtccttacaatgaccaatatggaccctgtggacacagccacatattactgttcacgctctatggttcggggagttattagtccctactttgactactggggccaggggaactctggtcaccgtctccgcagcctccaccaagggccc

SEQ ID NO: 534723 - DNA, 508 bp, Homo sapiens
  misc_feature: HEFZJCU01CLC1D.51.23.C01.1.454.heavy.3.raw
cgatcgtatacacgaccggtgctcgatttagtacacgtgattagggattggggacacataacaaccagattcctcctctaaagaagcccctgggagcacagctcatcaccatggactggacctggaggttcctctttgtggtggcagcagttacaggtgtccattcccaggtccagctggtgcagtctggggctgaggtgaagatgcctgggtcctcggtgaaggtctcctgcaagtattctggaggcaccttcagcaactatggtatcagctgggtgcgacaggcccctggacaagggcttgagtggatgggaagggtcacccctatatttgatgtagcagactctgcacagaagttccagggcagaataacaattacggcggacaaatccacgaccacagcctacatgagctgagcagcctgagatctgaggacacggtccctttattactgtgtcgagtatttaccggtgggggtcacggcggatatatcgccatactactttcg

SEQ ID NO: 534724 - DNA, 517 bp, Homo sapiens
  misc_feature: HEFZJCU01AX6GW.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactatttgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacggcggccgtatattactgtgcgagagtacgtagcggctcgttcctttgactacgtggggcctgggaactctggtcaccgtct

SEQ ID NO: 534725 - DNA, 539 bp, Homo sapiens
  misc_feature: HEFZJCU01BZIQJ.17.28.C06.1.454.heavy.3.raw
  modified_base (370)..(370): a, c, t, g, unknown or other
  modified_base (526)..(526): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgnggactctgtgaagggccgtttcaccatctccagagacaacgccaagaattcactgtatctacaactgaacagcctgagagtcgcagacacggccgtgtattacctgtgcgagatgtggaaaaatagtggctagtgttttatgggggccaggggacnccgtggtccaccg

SEQ ID NO: 534726 - DNA, 482 bp, Homo sapiens
  misc_feature: HEFZJCU01AU9ZT.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgaggactctcctgtgcagcctctggattcaccttcagtttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatcgaacagcctgagagctgaagacacggctgttgttttactgtgcgagagaga

SEQ ID NO: 534727 - DNA, 495 bp, Homo sapiens
  misc_feature: HEFZJCU01D3PJO.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggtttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaagggctggaatggatttcatacattagcagtagtggtgcgaccatatactacgcagactctgtgaagggccgattcatcatctccagagacaatggcaacaactcactgtatctggaatcaacagcctgagagtcgaggacacggctgtatattatgtgcgtagagcccctacgtgacg

SEQ ID NO: 534728 - DNA, 496 bp, Homo sapiens
  misc_feature: HEFZJCU01EIYTH.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaatgaacagcctgacagtcgacgacacggccatgttatttttgtgcgagcgacccgggggctcctcaat

SEQ ID NO: 534729 - DNA, 525 bp, Homo sapiens
  misc_feature: HEFZJCU01CIKED.11.67.G01.1.454.heavy.3.raw
cgagagataccacgaccggtgctcgatttagagtatacatattggggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtcgtggggcaaagggaccacggtcatcgtctcctcagcctccaccaacgggcccactcggtcttcccccgtggccaccctccctccaagagctacctctggggggcacgagccggccctcgggctgcctggtcaaggacttaccg

SEQ ID NO: 534730 - DNA, 491 bp, Homo sapiens; identical to SEQ ID NO: 447981
  misc_feature: HEFZJCU01DLDC2.47.85.H08.1.454.heavy.3.raw

SEQ ID NO: 534731 - DNA, 512 bp, Homo sapiens
  misc_feature: HEFZJCU01DZX39.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactaacgggaaagcttttgatctctgggccaagggacacgtggtcaccgtctcttcagcctccaccaacggcccatcggtccttccccctggccgccctgctccacggacg

SEQ ID NO: 534732 - DNA, 518 bp, Homo sapiens
  misc_feature: HEFZJCU01B1BL2.13.39.D06.1.454.heavy.3.raw
tcacgtactacacgaccggtgctcgatttagtgacatctcgcagttctttggggagctctgggagtggagccccagccttgggattcccaagtgtttgttttccgtgatcaggactgaacacacaggactcaccatggagttggggctgagctggattttccttcttgctatgttagaaggtgtccagtgtgaggtgcacctggtggagtctgggggaggcttggtacagcctggggggtccctgagactctcctgtgcagcctctggattcaccttcagtacctacgacatgcactgggtccgccaacctctaggaaaaggtccggagtgggtctcagggattggcagtgttggtgacacattctattcagactccgtgaagggccgattcaccatctccagagaaaatgccaacaactccttccatcttcaaatgaacagcctgagagacgggggacgacggctgtgtattactgtgcaagaggggcaattcttattactacttcgacgtctgggg

SEQ ID NO: 534733 - DNA, 542 bp, Homo sapiens
  misc_feature: HEFZJCU01A7UX3.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaagggcagattcatcatctcaagagatgattccaacggcatcgcctatctgcagatagaacagcctgaagaccgaggacacacgaccgtctacttacttggttgtttacggggtagtttttaaccgtatttttagggtaggttggagttatttaaaccg

SEQ ID NO: 534734 - DNA, 512 bp, Homo sapiens
  misc_feature: HEFZJCU01EEFN2.49.27.C05.1.454.heavy.3.raw
agtcgagagacacgaccggtgctcgatttagacgcgatcgaagggtttggggctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtcgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgaagaacacgctgtatctgacaaactagaacaggctagagagctagaagacgaccggactacggtattacgtttactggtgtaccgtaacgttaacgtaccg

SEQ ID NO: 534735 - DNA, 518 bp, Homo sapiens
  misc_feature: HEFZJCU01D0ZS2.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaaggcccatcggtcttccccctggccaccctcctccaagagcacctcgtgggggcacagccggccctggctgcctggtcaagactactccagacgtatca

SEQ ID NO: 534736 - DNA, 516 bp, Homo sapiens
  misc_feature: HEFZJCU01EYJZ1.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccatctattattgtgtcatagacctaggatacaacgacggtaggtacctggtt

SEQ ID NO: 534737 - DNA, 506 bp, Homo sapiens
  misc_feature: HEFZJCU01BZV3X.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaatgaacagtctgagagccgaggacacggctctctattactgtgcgagagaccccgaaaagtaggtactaacg

SEQ ID NO: 534738 - DNA, 524 bp, Homo sapiens
  misc_feature: HEFZJCU01CC48E.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaaggggattggagtggggtggcagtttgtttcatctgagggcagtgttcaatggtatgcagactccgtgaagggccgattccaccatctccagagacaattccaggaacacaatgtatttggaaatgaacagcctaagtcctgaggacacgggtgtatactactgtacgaagggaggggggaaccacggcgggagttccaagtacttcc

SEQ ID NO: 534739 - DNA, 525 bp, Homo sapiens
  misc_feature: HEFZJCU01DRKR0.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatacctatgcggactctgtgaagggccgattcaccattctccagagacaacgccaagaactcactatatttgcaaatggaccgcctgagagacgaggacacggctatgtattactgtgcgagagatgagagtggctacaggttgggggccggggaacccgtggttcacccgttcaaccg

SEQ ID NO: 534740 - DNA, 511 bp, Homo sapiens
  misc_feature: HEFZJCU01DZUFE.48.81.H04.1.454.heavy.3.raw
agtatacatacacgaccggtgctcgatttagtagtgtagattcgcggggagcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacgggccatttactactgtgcggcggggaggtgggacggagctacggttttcggagttatacatctactacttt

SEQ ID NO: 534741 - DNA, 525 bp, Homo sapiens
  misc_feature: HEFZJCU01EXODX.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaaccgccgacaacctcactgtctctgctgatgagcacgcctgagacgccgacgacacggctaatcttattactgtgacgtaaactctcattccgttcatctgaatacgtggggtccgacgggaacccctggtccgtccg

SEQ ID NO: 534742 - DNA, 535 bp, Homo sapiens
  misc_feature: HEFZJCU01EOB4L.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggcctttatattttctgtgcgagagccctcggcagaagtctggactactactattatggttatggacgtcgtggggccaacgggacgacggtcatcgtctcctcagcctccaccaacgggcccactcggtccttcccccttcggcaccctcctccaagagcacctctgggggcacgagcc

SEQ ID NO: 534743 - DNA, 487 bp, Homo sapiens
  misc_feature: HEFZJCU01BA95C.43.14.B03.1.454.heavy.3.raw
tgtgagtagtcacgaccggtgctcgatttagtgtgagtagttccgcgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacacgcctacatggagctgagcgaggctgagatctgacgacacggccgtgtatcactgtgcgagaggggagggggtataggacacgg

SEQ ID NO: 534744 - DNA, 535 bp, Homo sapiens
  misc_feature: HEFZJCU01C1SI6.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggataattactataacactgctcctttttacaccttcccttgactttcgtggggtccatcggaaccccggtcaccgtt

SEQ ID NO: 534745 - DNA, 491 bp, Homo sapiens
  misc_feature: HEFZJCU01ENWVD.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcgatcatctccagagacaactccaacaacacactggatctccaaatgaaacagcctgagagtcgaggacacggcccggtatattattgtgcccttgattacta

SEQ ID NO: 534746 - DNA, 510 bp, Homo sapiens
  misc_feature: HEFZJCU01EHJE7.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataaccgttcgcctggttattaccttgacacttggggccagggaaccctggtcaccgtctcctcagcctccaccaagggcccatcggtcttcccctggcgccctgctccaggacgcacctccgagagcacagcggccctgggctcgcctggtcaaggactacttccagacgtatca

SEQ ID NO: 534747 - DNA, 517 bp, Homo sapiens
  misc_feature: HEFZJCU01AF7BC.3.17.B06.1.454.heavy.3.raw
  modified_base (479)..(479): a, c, t, g, unknown or other
agacgcactccacgaccggtgctcgatttagtcgatagtgaagggggagagcggagccccagcccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccaggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacgacggccgtctattattgtntcatagacctaggatacaacgacggtgtacctggtatc

SEQ ID NO: 534748 - DNA, 530 bp, Homo sapiens
  misc_feature: HEFZJCU01C66IP.14.55.E11.1.454.heavy.3.raw
cgtctagtaccacgaccggtgctcgatttagcactcgcacgttgggtttggggggaagaggaagactgacggtccccccaggagttcaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaatgaatagcctgagagccgaggacacggctgtgtattactgtgtcagagatggaggggtggtgatccaggtatgattgtgtactctaccacgtctggacgtctggggccaagggaccacggtcaccgtctcctcagcctccaccaaggcccatcggtcttcccctggcaccctcctccaagagcacctctgggggcacgagccggccctcggggctgccgttcggtcaaggacctacttcccg

SEQ ID NO: 534749 - DNA, 538 bp, Homo sapiens
  misc_feature: HEFZJCU01BXF3V.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaacaccaagaacacactatatctgcagattgacagtctgagacccgaggacacggctgtgtattactgtgcaaggcagttcgtggaaacagttatgggttggggggagttggggtttttttttcgtacttacggggt

SEQ ID NO: 534750 - DNA, 538 bp, Homo sapiens
  misc_feature: HEFZJCU01DHH4M.49.86.H09.1.454.heavy.3.raw
agtcgagagacacgaccggtgctcgatttagtgctatagacttgggtttgggggagtctccttcaccacccagctgggatctcagggcttccttttctgtcctcctccaggatggggtcaaccgccatcctcgccctcctcctggctgttctccaaggggtctgtgccgaggtgcaactggtgcagtccggagcagaagtgaaaaagcccggggagtctctgaggatctcctgtaagatttctggagacaccttaaccacctattggatcagctgggtgcgtcagatgcccggtaaaggcctggaatggatggggatgattgatcccagtgactcttttaccacgtacggcccgtccttccaatggcacgtcaccatctcagctgacaagtcccaaaggagtgcctccctggagtggaccagcctggagggcctcggacaccgccatgtattactgtgcaagtgggggtcgggggagcagtgtctggcaattattactactactctgtggacgtcgtggggccgaggggacctcgggt

SEQ ID NO: 534751 - DNA, 531 bp, Homo sapiens
  misc_feature: HEFZJCU01EKIXX.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactggggaaccccacctatgcccaggccttcacagggcggtttgtcttctccatggatacctctgtcgggacggcttatctgcagataaccaccttcaacctgacgacactgccgtttattttgttacgagagcgtcgtctgtcagtggattgactactggggccgagggaaccctggtcaccgtctcctcagcctccaccaagg

SEQ ID NO: 534752 - DNA, 480 bp, Homo sapiens
  misc_feature: HEFZJCU01DE278.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactccgacggacacgggtgtagtattactgtggaagacggcccc

SEQ ID NO: 534753 - DNA, 504 bp, Homo sapiens
  misc_feature: HEFZJCU01CW9LA.5.70.G04.1.454.heavy.3.raw
atcagacacgcacgaccggtgctcgatttagtgtagtgtgaagggaaagggggggagaggagccccagccctgagattcccaggtgtttccattcagtgatcagcactgaacacagaggactcaccatggagttgggactgaactggattttccttttggctatgttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctagtgcggactctgtgaagggccgcttcaccatctccagagacaacgccaagactccctgtatctacaaatgaacagttctgagagttgaggacacggccttctattactgtgcaaagatcgggacgaagtggtggtggctgac

SEQ ID NO: 534754 - DNA, 503 bp, Homo sapiens
  misc_feature: HEFZJCU01DPRZF.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaatatggtatgaattgggtgcgacaggcccccggacaagggcttgagtgggtggggtgggtcagcggctttgacggtaaggcacagtatgcaccgaagatgaaggggcagagtcacgattaccacggacacccccacgaacacagtctacatgcactgacgagcctgagagctgacgacacggccgtctattactgtgcgagaatgttttctgtcatcgtacaactttgataggctctatggactggtacttcgtc

SEQ ID NO: 534755 - DNA, 515 bp, Homo sapiens
  misc_feature: HEFZJCU01CW47E.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaaggactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaaggagatgattcagagaactcaactttatctgcaaatgaacagcctagacgaaccgacgacgaccggccgtactattattgtgtcatagacctaggatacaacgac

SEQ ID NO: 534756 - DNA, 504 bp, Homo sapiens
  misc_feature: HEFZJCU01BQ0FV.4.57.F02.1.454.heavy.3.raw
agcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcggggggaggcgtgggtccagcctggggggtccctgagactctcctgtgcagcgtctggattcgccttcagtgcctatggcatgcactgggtccgccaggctccaggcaaggggctggaatgggtgcagttatatggttgatggaactaacaaattctatgcagactccgtgaagggccgattcaccatctccagagacaatttcgagaacacattgaatctacagatgaacagtctgagagcgaggacacggctgtctattattgtgcgagagtaagtggtcatggttcctttacg

SEQ ID NO: 534757 - DNA, 529 bp, Homo sapiens
  misc_feature: HEFZJCU01CFNDY.11.25.C03.1.454.heavy.3.raw
cgagagataccacgaccggtgctcgatttagtagtgtagatttggggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaatgaacagcctgagagccgatgacacggccgtgtattactgtgcgagagagtggggcccacgaacgttactacgctatggacgtctggggccaagggaccgacc

SEQ ID NO: 534758 - DNA, 531 bp, Homo sapiens
  misc_feature: HEFZJCU01CW49U.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaagtgagttctgtgaccgtcgcagacgacggctgtctattatttgtgcgagacggcaaatatggttcagggagttcgactactggggccaggggaaccctggtccaccgtctccctctagcctccaccacgggacccg

SEQ ID NO: 534759 - DNA, 553 bp, Homo sapiens
  misc_feature: HEFZJCU01ACVID.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttggagtggatgggaaggatcgtccctatcgttgacacaccaaactacgcacagaagttccagggcagactcaccataacccgcggacaaattaacgaacacagttaatctggagctgaacagcctgtcatctgaggacacgggcttctacttctgtgcgaggagtaattactataacactagctcctttttacctaccttacccttcgtacttcgtgggggtcctagtcggtaacccccggtacgtacccggtt

SEQ ID NO: 534760 - DNA, 456 bp, Homo sapiens
  misc_feature: HEFZJCU01EHC9F.48.40.D07.1.454.heavy.3.raw
  modified_base (352)..(352): a, c, t, g, unknown or other
  modified_base (411)..(411): a, c, t, g, unknown or other
agtatacatacacgaccggtgctcgatttagtgatagagcggtaacaacagagggggagccccagacctgggattcccagctgtttctgcttgctgatcaggaccgcacacagagagctcaccatggagttggggctgacctggggttttccttgtggctactttaagaggtgtcctgtgtcgaggtgcacctgctggagtccgggggaggcttagttcggccggggagtccctgagactcgcctgtgtagtgtctggattcaccttcaggaattacgacatggactgggtccgccaagctccagggaaggggctggagtgggtctcaaacgtgaacgttgatggcgggatnacaaaatacgcggactccgtgaaacggccgctcaccgtctccagagacaacgcgagaanactcgtgtatttagcctagatggagaaagtctcgagaggcgaagg

SEQ ID NO: 534761 - DNA, 507 bp, Homo sapiens
  misc_feature: HEFZJCU01BRWGY.9.34.D01.1.454.heavy.3.raw
tgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccaggggagggactggagtgggtcgcgggcatcgctggtggcggtcatgacacattctacgcaaactccgtgagggccgcttcatcatctccagagacaattcccagaacatactgtctctgcaactcaataacctgagaggcgaggacacggccatttattctgtgcgaaggaggcatatgggaagtacgattttcgatccctccgcagtcgactacttgattactgggcgggacctggtcgccgtctctcagcctcacagggccatcggtcttccctgcacctcctca

SEQ ID NO: 534762 - DNA, 465 bp, Homo sapiens; identical to SEQ ID NO: 444805
  misc_feature: HEFZJCU01BJAJN.19.10.A10.1.454.heavy.3.raw

SEQ ID NO: 534763 - DNA, 495 bp, Homo sapiens
  misc_feature: HEFZJCU01CCABS.17.36.D03.1.454.heavy.3.raw
cgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtaccgcctggggggtccctgagactctcctgtagagcctctggattcgccttcagtacctacagcatgaactgggtccgccaggttccagggaagggtctggagtgggttgcatacattagtagtagtgatagttccatatactacgcagactctgtgaagggccgattcaccatctcccagagacagtgccaagaactcactgtatctgcaaatgaacagcccttagagacgacgaccacggctgtgtattacttgtgcgagagatcccgctcg

SEQ ID NO: 534764 - DNA, 508 bp, Homo sapiens
  misc_feature: HEFZJCU01EUONA.11.72.G06.1.454.heavy.3.raw
  modified_base (470)..(470): a, c, t, g, unknown or other
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatgggatcaactctcacactggaagcagagtctatgcggagagattccagggcagagtcaccctgaccacagagacatccacgaccacagtctacatggagctgtggagcctgagacctgacgacacggccctctattactgtgcgaggccctatcctanagtgaccactccacgctggttcgacctcgtggggccac

SEQ ID NO: 534765 - DNA, 386 bp, Homo sapiens
  misc_feature: HEFZJCU01CXONC.11.57.F02.1.454.heavy.3.raw
  modified_base (232)..(232): a, c, t, g, unknown or other
  modified_base (384)..(384): a, c, t, g, unknown or other
cgagagataccacgaccggtgctcgatttagctcgatatagttgggtttgggggcagggtgtacacctgtggttctcggggctgccctttggctttggagatggttttctcgatggggctgggaggctttgttggagaccttgcacttgtactccttgccattcagccagtcctggtgcaggacggtgaggacgctgacctacacggtactgctgttgtactgctctcccgnggctttgctggcattatgcacctccacgccgtccacgtaccagttgaacttgacctcagggtcttcgtggctcacgtccaccaccacgcatgtgaccgtcagggtccgcaggctccaggtaaggggctggaatggtatttcaattacattancg

SEQ ID NO: 534766 - DNA, 521 bp, Homo sapiens
  misc_feature: HEFZJCU01BHE4A.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgatccaccatctccagagacaattacaagaacaccctttatctgcaaatagacagcctgagaccagacgacacggctgtctattattgcgcgagagagacacacgaacctactggccaatactatgggggcttgttcgtggggccgaggggaccctggtcatcgtcttccccagcctccaccacgggcccagtcggtcttccccc

SEQ ID NO: 534767 - DNA, 503 bp, Homo sapiens
  misc_feature: HEFZJCU01A98UN.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcaccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttcgtc

SEQ ID NO: 534768 - DNA, 476 bp, Homo sapiens
  misc_feature: HEFZJCU01C076V.48.51.E07.1.454.heavy.3.raw
agtatacatacacgaccggtgctcgatttagcatactctacaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacacgaagtttcagggcagggtcaccatgaccagggacacggtccatcagcacagcctacatggaattgagcaggctgacatctgaccgtacacggccgtggtatttattgtgtcgagag

SEQ ID NO: 534769 - DNA, 395 bp, Homo sapiens; identical to SEQ ID NO: 444923
  misc_feature: HEFZJCU01BLK6K.16.68.G02.1.454.heavy.3.raw

SEQ ID NO: 534770 - DNA, 497 bp, Homo sapiens
  misc_feature: HEFZJCU01DDB0C.4.7.A07.1.454.heavy.3.raw
  modified_base (413)..(413): a, c, t, g, unknown or other
  modified_base (492)..(492): a, c, t, g, unknown or other
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatcttagcagctatgccatgagctgggtccgccaggctccagggaagggctggaatgggtctcatctattagtgctactactggtggcacatacttcgcagactccgtgaagggccggttcgtccatctccagagacaattccaagaacacgcngtatctgcaattgaacagcctgagagccgaggacacggccgtatattactgtgcgaaagacgtttggggaatggaaccncgtac

SEQ ID NO: 534771 - DNA, 516 bp, Homo sapiens
  misc_feature: HEFZJCU01EJY7F.9.34.D01.1.454.heavy.3.raw
tgatacgtctcacgaccggtgctcgatttagatcgtctgtgttgggtttgggggaggcttggtccagcctggggagtccctgcgactctcttgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattactggggccgggaaccctggtcgccgtctcctcagcctccaccaagggcccatcggtcttccccctggccaccctcctccaagagcacctctgggggcacagcggccctgggctgcctggtcaaggactactccagactatca

SEQ ID NO: 534772 - DNA, 482 bp, Homo sapiens
  misc_feature: HEFZJCU01EECIF.47.59.F04.1.454.heavy.3.raw
agctcacgtacacgaccggtgctcgatttagtacacacacttagggattggggggtccctgagactctcctgtgcagcctctggattcattttcagtggctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttcccctggcgccctgctccaggagcacctccgagagcacagcggccctgggctgcctggtcaaggactacttcctacgtgagct

SEQ ID NO: 534773 - DNA, 517 bp, Homo sapiens
  misc_feature: HEFZJCU01AWE88.48.45.E01.1.454.heavy.3.raw
  modified_base (448)..(448): a, c, t, g, unknown or other
agtatacatacacgaccggtgctcgatttagtgagtcagtaagggaaaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagacctctggatacaccttcacgaactgtgctatttcattgggtgcgacaggcccctggacaagggcttgagtggatggggtggatcaacaccaacactgggaacccaacgtatgcccagggcttcacaggacgatttgtcttctccttggacacctctgtcaatacggcacatctgcagatcaccagcctgaagactgaggacactgccgtgtattnttgtgtgagacgaagtagtagctcgtccctcctttgactactgggccagggaaccctggtacaccgcct

SEQ ID NO: 534774 - DNA, 527 bp, Homo sapiens
  misc_feature: HEFZJCU01CVWLR.13.65.F10.1.454.heavy.3.raw
tcacgtactacacgaccggtgctcgatttagctacgctctaaggggacccaaaaacccacaccccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacatttttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagccctacatggaactgaggaatctgacatctgacgacacggccatatattactagtgcgagaaggacggtttttggggcggcggactcctctgagatcgtgggccgaggggacaagtggtcaccgtctcttca

SEQ ID NO: 534775 - DNA, 491 bp, Homo sapiens
  misc_feature: HEFZJCU01EMCDI.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcacctttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagactgacgacacgtctctctactactgtgcgagagagttgacgagt

SEQ ID NO: 534776 - DNA, 492 bp, Homo sapiens; identical to SEQ ID NO: 447005
  misc_feature: HEFZJCU01ELCUP.53.26.C04.1.454.heavy.3.raw

SEQ ID NO: 534777 - DNA, 513 bp, Homo sapiens
  misc_feature: HEFZJCU01DAUID.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctggggaactctggtcaccgtct

SEQ ID NO: 534778 - DNA, 498 bp, Homo sapiens
  misc_feature: HEFZJCU01DQALU.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctggggggaggcgtggtccagcctgggaggtccctggagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtagttactggtgggagagatgggaggtcgatattgta

SEQ ID NO: 534779 - DNA, 503 bp, Homo sapiens
  misc_feature: HEFZJCU01DVQFV.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctggtgtatttactgtggggagagatagggaggtcgattagttgta

SEQ ID NO: 534780 - DNA, 487 bp, Homo sapiens
  misc_feature: HEFZJCU01CDLOI.8.39.D06.1.454.heavy.3.raw
ctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctggagacttggacgacacggccgtatattactgtgcgagaatcgaagaaggtggctac

SEQ ID NO: 534781 - DNA, 522 bp, Homo sapiens; identical to SEQ ID NO: 472118
  misc_feature: HEFZJCU01B3YPM.13.76.G10.1.454.heavy.3.raw

SEQ ID NO: 534782 - DNA, 508 bp, Homo sapiens
  misc_feature: HEFZJCU01CBA4B.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagtttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggcctccagggaaggggctggagtgggtctcagttattgaaacagatggcactacatattattctgactccgtgaagggccggttcaccctctccagagcacttccaacaacatcttgtatcttcacatgcacaatctgagagtcgacgacacggccacctattattgtgcgcgacatgactacgcctcaattctggggccagggaccg

SEQ ID NO: 534783 - DNA, 534 bp, Homo sapiens
  misc_feature: HEFZJCU01ANM8F.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggaccggcttatctgcagataaccaaccttcaacctgacgacactgccgttttattttgtacgtagagcgtcgtctgtcagtggaattgactactggggccagggaaccctggtcaccgtctcctcacgcctccacaaggg

SEQ ID NO: 534784 - DNA, 506 bp, Homo sapiens
  misc_feature: HEFZJCU01EESLI.48.34.D01.1.454.heavy.3.raw
agtatacatacacgaccggtgctcgatttagatcgtctgtgttgggtgtggtccagcctgggaagtccctgacactgtcctgcgcagcctctggattcaccttcaccacctttccgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcggggagggatattacttgacaactggggccagggaaccctggtcaccgtctcctcacgcctccaccaagggcccatcggtcttcccctggcgccctgctccaggagcacctccgacgacggcacagccggcccgtgggcgtgcctggtcaaggactacttcctatgtatact

SEQ ID NO: 534785 - DNA, 533 bp, Homo sapiens
  misc_feature: HEFZJCU01EQDCK.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccggggggagacttggtccagcctgggggggtccctgagactctcctgtgtagcctctggatttgtttttagtgactattggatgagttgggtccgccaggctccagggaaggggctggagtgggtggccaacataaagtacgatgaagttgagataattatttggactctgtgaagggccgattcaccatctcgagggacaacgccaagaactcgctgtatctgcaaatggagagcctgagagccgaggacacggctgtatattattgtgtgagattagcgcacttactttgactactgggggccagggaaccctggtacaccgt

SEQ ID NO: 534786 - DNA, 516 bp, Homo sapiens
  misc_feature: HEFZJCU01DHSFH.40.67.G01.1.454.heavy.3.raw
tctagcgactcacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgcagccccaggaaagggctccaatgcgttggacatgtcaattcttatgggcgcgtcccactacagtgcggccctccagagtcgagccctcatatccatagacacgtccaagaaccagtttccctgacgctgacgtctgtgaccgccgcagacacggctgtctattattgtgcgagactagccttctgtagtgggggtacttgcaacccgggatactactccaccttcggcttggacatctcggggccgtac

SEQ ID NO: 534787 - DNA, 530 bp, Homo sapiens
  misc_feature: HEFZJCU01ENRDS.48.38.D05.1.454.heavy.3.raw
  modified_base (475)..(475): a, c, t, g, unknown or other
  modified_base (506)..(506): a, c, t, g, unknown or other
agtatacatacacgaccggtgctcgatttagtatctgatagttgggtttggggtctgggagaggagctccagccttgggactcccagctgtctccactcggtgatcggcactgaatacaggagactcaccatggagtttgggctgagctgggttttccttgttgctattttaaaaggtgtccagtgtgaggtgcagttggtgcagtccgggggaggcttggtccagcctggggggtccctgaaactctcctgtacagcctctgggttcgccttcacagcctctgggttcagcttcagtgcctctgctatgcactgggtccgccaggcttccgggagagggcttgagtgggtggccgtattagaacaaacctaataattacgcgacagcatttgctgcgtcggtgagaggcaggttcaccctctcagagacgattccaagaacacggcgtatctgcaaatggacaactgaaaccgngacacggccgtttattattgtacttctaggnggtgacgggaacgctggctagttc

SEQ ID NO: 534788 - DNA, 494 bp, Homo sapiens
  misc_feature: HEFZJCU01EQXRU.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctcgtgacgacacggccatgtattactgtggaagagacgttggtggtctaccgcggggctgaccac

SEQ ID NO: 534789 - DNA, 519 bp, Homo sapiens
  misc_feature: HEFZJCU01B8GEH.3.6.A06.1.454.heavy.3.raw
agacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtggctccatcagtcgtttttactactactggagttggatccggcagtccccagggaagggactagagtgggttggccatatgcatcacagtgggagcaccaactacgaacccctccctcgagagtcgagtcaccatatcaatagacacgtccaagaccagttctccctgagcttgagtctgtcaatgctgcggacacggccgtttattactgtgcgagtactgcggggaaagatccatttgatagtttggggcctaaggaacaatggtcaccgtctcttcagccctccaccaacggg

SEQ ID NO: 534790 - DNA, 519 bp, Homo sapiens
  misc_feature: HEFZJCU01D8KQT.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaaggcccatcggtcttcccctggcgccctcgctccaggagcacctccgagagcacagcggcccgtcgggcgtcgg

SEQ ID NO: 534791 - DNA, 509 bp, Homo sapiens
  misc_feature: HEFZJCU01EO2GR.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacaggacttaccatgaccacgaactcctccataaacacagcctacatggagttgaggagcctgacatctgacgacacggccgtctattactgtgcgagacgtcccacgatccggtgagcctacggcagcggctttgacttctggggccagggacg

SEQ ID NO: 534792 - DNA, 539 bp, Homo sapiens
  misc_feature: HEFZJCU01EB7HF.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttacttcaaatggacagcctgaaagacgaagacacgggcgtgtatttttgtgttgaaagatacgaagtctatgatacccaatttgggaggggcctttcatgtctggggccaagggacgctggtcaccgtctcttcagcctccaccaaggcccatcggtccttcccctggccaccctcctccaagagcacctctggggcacagcc

SEQ ID NO: 534793 - DNA, 533 bp, Homo sapiens
  misc_feature: HEFZJCU01AZ7N3.18.33.C11.1.454.heavy.3.raw
  modified_base (336)..(336): a, c, t, g, unknown or other
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttanagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggggcccgggaacccgtggtcaccgtctccccaccctccaacccg

SEQ ID NO: 534794 - DNA, 524 bp, Homo sapiens
  misc_feature: HEFZJCU01BLJZM.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattccaccatctccagagacaattccaagaacacgctgtttcttcaaatgaacagcctgagagccgatgacacggccgtgtattactgtgcgagagagtggggcccacgaacgttactacgctatgggacgtcgtggggccaaggggaccg

SEQ ID NO: 534795 - DNA, 487 bp, Homo sapiens
  misc_feature: HEFZJCU01ECOBY.40.73.G07.1.454.heavy.3.raw
tctagcgactcacgaccggtgctcgatttagctctacgctcagggcacgaccggtgctcgatttagctctacgctcggggcacgaccggtgctcgatttagtagtgtagattcgcggggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggagtggggtggatcaaccctaccagaggtggcacaagtatcgacagaactttcagggcagggtcaccatcgacctggggacgcgtccatcagcacagtctacatggat

SEQ ID NO: 534796 - DNA, 539 bp, Homo sapiens
  misc_feature: HEFZJCU01DUR6T.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagtttacgtggactctgtgaagggccgtttcaccatctccagagacaacgccaagaattcactgtatctacaactgaacagcctgagagtcgcagacacggccggtgtattactgtgcgagatgtgaaaagtaatggctgtgtttagttgggggccaggggagcccgtggtcctaccg

SEQ ID NO: 534797 - DNA, 374 bp, Homo sapiens; identical to SEQ ID NO: 444640
  misc_feature: HEFZJCU01CPXK8.7.37.D04.1.454.heavy.3.raw

SEQ ID NO: 534798 - DNA, 522 bp, Homo sapiens
  misc_feature: HEFZJCU01CK1BW.4.23.C01.1.454.heavy.3.raw
agcactgtagcacgaccggtgctcgatttagtacacgtgattagggagttggggacccaaaaaccacacccctccttgggcgaatcccctagatcacagctcctcaccatggactggacctggagcatcctttttcttggtggcagcagcaacaggtgcccactcccaggttcacctggagcagtctggacctgaggtgaagaagcctggggcctcagtgaaggtctcctgccaaggcttctggctacacctttaccacctatggtgtcaactgggtgcgacaggcccctggacaagggcttgagtggatgggatggatcaagcgcttacaatgggaacacaaactatgcacagacgttccagggcagagtcaccattaccacagacacatccacgaagcacagcctacatggaccctgaggagcctgagatttgacgacacggccatatattacgtgtgcgagagattggggccgacggaaaccttgactactggggccagggaaccctggtcaccgtccg

SEQ ID NO: 534799 - DNA, 526 bp, Homo sapiens
  misc_feature: HEFZJCU01DRPB1.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtagataccatatactacgtcagactctgtgaagggccgattcaccatctccagggacacgccaagactcacgtgactttgcaaatgaacaccctgcgagccgaggacacggccgtatattactgtgcgagaactaacccgtttcgccttggttatttaccg

SEQ ID NO: 534800 - DNA, 537 bp, Homo sapiens
  misc_feature: HEFZJCU01CK618.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatcctccagagacaattccaagaacacgctgtttcttcaaatgaacagcctgagagccgatgacacggccgtgttattactgtgcgagagagtcgggggcccacggaaccgttactaccggtctatgggacgtcgtcgggggccgaacggggacccg

SEQ ID NO: 534801 - DNA, 498 bp, Homo sapiens
  misc_feature: HEFZJCU01BG6EH.49.29.C07.1.454.heavy.3.raw
agtcgagagacacgaccggtgctcgatttagagtgctacgaagggaaagggggggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtctggggggaggcgtggtccagcctgggaggtccccgagactctcttgtgctgcctctggattcaccttcagggtctatgacatgcactgggtccgccaggctccgaggcaaggggctggagtgggtggcatttatatcatatgatggaagcaagatatactatgtagactccgtgaagggccgattcatcatctccagagacaactccgagaacacgctgtatctgcaaatgaacaggctggagagctgaagacacggctttatattactgtagcgaacttaatcacggagacgaac

SEQ ID NO: 534802 - DNA, 532 bp, Homo sapiens
  misc_feature: HEFZJCU01EDDXA.53.21.B10.1.454.heavy.3.raw
cgcgtatacacacgaccggtgctcgatttagtgtcgtcgcaagggggctctgagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcggggggaggcttggtacagccgggggggtccctgagactctcctgtagagtctctggcttcacctttagagtctatgacatgagttgggtccgccaggctccggggaaggggctggagtgggtctcaacgatcagtgatagcggaagtaccacaaactacgccgcctccgtgaagggccgatgcaccgtctccagacgacaattcgaaggacactttatatctgcaactcaacagactgacaaccgctgacacggcgtctattactgtgtcaaagaagacggaccgctggacgaggagccgaggaaggaaaatcacttaactttgacctac

SEQ ID NO: 534803 - DNA, 512 bp, Homo sapiens
  misc_feature: HEFZJCU01A32UT.9.12.B01.1.454.heavy.3.raw
tgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctgggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccaggaacacgactgtatcttcaaatgaacagcctgagagtcgaggacacggctgtatattactgttgcgagagatggtgtacgcttttgattatctggggaccg

SEQ ID NO: 534804 - DNA, 500 bp, Homo sapiens
  misc_feature: HEFZJCU01B433G.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaacgtcctatgcttttgatatctggggccaagggg

SEQ ID NO: 534805 - DNA, 506 bp, Homo sapiens
  misc_feature: HEFZJCU01CIKO5.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgacttaccgacggacacccccacgaacacagtctacatgcaactgacgagcctgagagctgacgacacggccgtctattactgtgcgagaattgttttctgtcatcgtacaatttgataggctctatggaactggacttcgtc

SEQ ID NO: 534806 - DNA, 514 bp, Homo sapiens
  misc_feature: HEFZJCU01EK3M8.51.36.D03.1.454.heavy.3.raw
cgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagccccccgggaaggggctggattggattggcagtatcagttatactgggaccaccttcttcaagtcgtcgctcaagagtcgagtcaccatgaccgcggaacacgtccaaggaccagttctccctgaagctgacctctgtgaccggccgcagacacggctttgtactttctgtgctagatataatgtgggtgacagtggtgcctactacggagtcttttgattagtttggggcccaaggcacgtaac

SEQ ID NO: 534807 - DNA, 535 bp, Homo sapiens
  misc_feature: HEFZJCU01BVEEW.13.28.C06.1.454.heavy.3.raw
  modified_base (478)..(478): a, c, t, g, unknown or other
tcacgtactacacgaccggtgctcgattagagctcacgtattgggtttgggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctgggggggtccctgagactctcctgtgtagcctctggatttgtttttagtgactattggatgagttgggtccgccaggctccagggaaggggctggagtgggtggccaacataaagtacgatgaagttgagataaattatttggactctgtgaagggccgattcaccatctcgagggacaacgccaagaactcgctgtatctgcaaatggagagcctgagagccgaggacacggctgtatattattgngtgagatttagcgtcactactttgactactggggccagggaacccctggtccaccgt

SEQ ID NO: 534808 - DNA, 520 bp, Homo sapiens
  misc_feature: HEFZJCU01EP1R7.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcgggggagttagttagtcccttactttgactactggggccaggggaactctcggtcaccgtctccgcagcctccgaccaacggccca

SEQ ID NO: 534809 - DNA, 520 bp, Homo sapiens
  misc_feature: HEFZJCU01CSPYZ.40.29.C07.1.454.heavy.3.raw
tctagcgactcacgaccggtgctcgatttagagtgctacgaagggaaagggggctcagcactgaacacagaccaccaaccatggagttagggcctagctggcttttccttgttgctcttttaaagggtgtccgatgtgaggcgcagctggtggagtctgggggaggattggttcagccagggcggtccctgagactctcctgtacagcttctggattcccctttggtgattatacaatacattgggtccgccaggcgccagggaagaggctggagtgggtgggtttcgttagctcgaaaccttatcatgggccacctgaatacgccgcgtctgtgaaaggcagattcatcatctcaagagagaattccaagagcaccgcctatctgcaaatgaacagctgaaaccgaggacacagccatatattattgtactggagccgaatttgtacaaatgtgtattcccttcacgtaatggtctttgatatctggggccaggggacacgtgtccacgtctcttcagt

SEQ ID NO: 534810 - DNA, 513 bp, Homo sapiens
  misc_feature: HEFZJCU01BS21L.2.33.C11.1.454.heavy.3.raw
acgctcgacacacgaccggtgctcgatttagagtgagctcgttgggtttgggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgttggatgaattgggtccgccaggctccagggaaggggctggagtgggttggccatataaaagtaagactgctggtgagacaacagactacgctgctgccttcagaggcagattcaccatcttcagagatgaatcacagagcactctgtttctgacaatgaacagcctggaagcgacggacacagccatgtattattggtacagttaggacactatagtccctggggccaggggaacccctac

SEQ ID NO: 534811 - DNA, 507 bp, Homo sapiens
  misc_feature: HEFZJCU01EIQ0H.48.81.H04.1.454.heavy.3.raw
  modified_base (489)..(489): a, c, t, g, unknown or other
  modified_base (491)..(491): a, c, t, g, unknown or other
  modified_base (503)..(503): a, c, t, g, unknown or other
agtatacatacacgaccggtgctcgatttagtagtgtagattcgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggagtggacggagctcggtttcggagttntnatctactctttntacg

SEQ ID NO: 534812 - DNA, 527 bp, Homo sapiens
  misc_feature: HEFZJCU01CV3RK.13.55.E11.1.454.heavy.3.raw
tcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttcgactctcctgtgcagcctctggaatcactttcagtgacgcctggatgaactgggtccgccaggctccagggaaggggctggagtggattggccgtattaaaagtgagcctgatgggtgggacaacagactacgctgcacccgtgaagggcagattcaccatctccagagatgattcaaggaacacagtgtttctgcaaatagaacagcctgactgaccggggacactgccgtgtattacgtgtgaccagcacgcagtaccgtcggccactattattttttagtactttcgtc

SEQ ID NO: 534813 - DNA, 478 bp, Homo sapiens; identical to SEQ ID NO: 450660
  misc_feature: HEFZJCU01A52Q0.16.10.A10.1.454.heavy.3.raw

SEQ ID NO: 534814 - DNA, 463 bp, Homo sapiens
  misc_feature: HEFZJCU01BWYY4.2.28.C06.1.454.heavy.3.raw
acgctcgacacacgaccggtgctcgatttagagctcacgtattgggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactggggcccgggagccctggtcaccgtctcctcagcctccaccaagggcccatcggtcttcccctggcgccctgctccaggagcacctccgagagcacagcggcccgtgggctgcctggtcaaggactacttcctgtcgagcgt

SEQ ID NO: 534815 - DNA, 519 bp, Homo sapiens
  misc_feature: HEFZJCU01DHQ6F.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccgggtgacgccgtacggcaggcggtcctttgactttcgtcgggggccaaggggccg

SEQ ID NO: 534816 - DNA, 518 bp, Homo sapiens
  misc_feature: HEFZJCU01DVKBP.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgtagagtcgacgatacggctgtctatcattgtgttttcgatgccgtttcggtccgcgggacttcgtggggccagggtaaccccg

SEQ ID NO: 534817 - DNA, 522 bp, Homo sapiens
  misc_feature: HEFZJCU01CPUJW.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggactctggtcaccgtctcctcagcctccaccaagggcccagtcggtccttcccccgtggccgccctgctccaggacgcacctccgagagcacagcggcccgtgggctcg

SEQ ID NO: 534818 - DNA, 398 bp, Homo sapiens
  misc_feature: HEFZJCU01DX6KG.48.75.G09.1.454.heavy.3.raw
agtatacatacacgaccggtgctcgatttagtatagacatcagggaaaggggctggagtgggtctcagtcccattagtagtagcagtaattatatagacgacgcagactcagtgaagggccgattcaccatctccagagacaacgccaaggcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctggggcacagcggccctgggctgcctggtcaaggactacttcctatgtatact

SEQ ID NO: 534819 - DNA, 511 bp, Homo sapiens
  misc_feature: HEFZJCU01APXO9.52.23.C01.1.454.heavy.3.raw
  modified_base (461)..(461): a, c, t, g, unknown or other
cgcagtacgacacgaccggtgctcgatttagtacacgtgattagggattgggggggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaaataagaaatactatatagactccgtgaggggccgattcaccatctccagagacaattccaagaacacgctgtatctgcacatgaacagcctgagagccgaagacacggggtntttattactgtgcgaacttaattacggaggacaacggtaatgcccgtccg

SEQ ID NO: 534820 - DNA, 498 bp, Homo sapiens
  misc_feature: HEFZJCU01CD78Y.47.85.H08.1.454.heavy.3.raw
  modified_base (459)..(459): a, c, t, g, unknown or other
agctcacgtacacgaccggtgctcgatttagtatcactcagtcgcggggagctctgggagaggagccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggagcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagtactccctgaggggccgattcaccatctccagagacaattcccagaacacggtctatctgcacctgaaccagccctgagaaactgacgaacncgtctctctactactgtgcgagagagtttgagtaggtct

SEQ ID NO: 534821 - DNA, 525 bp, Homo sapiens
  misc_feature: HEFZJCU01DSXPG.3.82.H05.1.454.heavy.3.raw
  modified_base (517)..(517): a, c, t, g, unknown or other
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgacccgtgaagggccgattaaccatctccagagacgattccgagaacacgggtgtatcttcaaatgaaacaacctgagagccgacgacacggccgtttatactgtgcgagagattcgagtgggttcggggacctcacccgtggttctacttcgatctntcggggcc

SEQ ID NO: 534822 - DNA, 522 bp, Homo sapiens
  misc_feature: HEFZJCU01C59GK.49.29.C07.1.454.heavy.3.raw
agtcgagagacacgaccggtgctcgatttagagtgctacgaagggaaagggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagcccccagggaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtgacgtctggggcaaggaccacggtcaccgtctcctcagcctccaccaac

SEQ ID NO: 534823 - DNA, 495 bp, Homo sapiens
  misc_feature: HEFZJCU01DCH5N.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtactatctgcacctgaccagcctgagaactgacgacacgtctctctacttactgtgcgagagagttgacgagtct

SEQ ID NO: 534824 - DNA, 511 bp, Homo sapiens
  misc_feature: HEFZJCU01BNSVY.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcacggagtcgggtcaccatatcagtagacacgtccaagagccagttcctccctgaagctgagggctgtgagcgccgcagacacggccgtgtattactgtgcgagactggccgcaacagacgtacggtggcaactcctatgtcttttgatatcgtggggccaaggggacaagtc

SEQ ID NO: 534825 - DNA, 492 bp, Homo sapiens
  misc_feature: HEFZJCU01E09S9.49.48.E04.1.454.heavy.3.raw
agtcgagagacacgaccggtgctcgatttagagagcgtcacagagagaagggggcatcatccaacaaccacatcccttctctacagaagcctctgagagggaagttcttcaccatggactggacctggagggtcttctgcttgctggctgtagctccgggtgctcactcccaggtgcagttggtgcagtctggggctgaggtgaagaagtctggggcctcagtgaagatttcctgcaaggcttctggataccccttcaccatctaccacatgcactgggtgcgacaggccccgggacaagggcttgagtggatgggaataatcaaccctagtggtggtagcacaacctccgcacagaggttccagggcagagtcaccatgaccagggacacgtccacgagcacattctacatggaactgagccgcctgagatctgacgacacggccgtgtactactgtgcgagagtcactcattaacctacgattagttagt

SEQ ID NO: 534826 - DNA, 484 bp, Homo sapiens
  misc_feature: HEFZJCU01CTAG2.48.41.D08.1.454.heavy.3.raw
  modified_base (469)..(469): a, c, t, g, unknown or other
agtatacatacacgaccggtgctcgatttagtcacgcgagaaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtatagcaaactacgcacagaagttccagggcagagtcacgattaccgcggacaaatccacgagcacagcctacatggagctgagcagcctgagatctgaggacacggccgtgtattactgtgcgagagatcagngtggttattatctcc

SEQ ID NO: 534827 - DNA, 516 bp, Homo sapiens
  misc_feature: HEFZJCU01EQZW0.48.37.D04.1.454.heavy.3.raw
agtatacatacacgaccggtgctcgatttagtagcatactgttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggcgtagtattactgtgcgagagtaagggtttactagttagggttcggggagtcgtccgacccacgcaacgtggttaccc

SEQ ID NO: 534828 - DNA, 491 bp, Homo sapiens
  misc_feature: HEFZJCU01DH2BZ.3.75.G09.1.454.heavy.3.raw
agacgcactccacgaccggtgctcgatttagtatagacatcaggggggacactgagtgtgagtgaacatgagtgagcaaaactggatttgtgtgccatttttctgataacggtgtccttctgtttgcaggtgtccagtgtcaggtgcagctggtgcagtcggggggaggcgtggtccagcctgggaggtccctgagactctcctgtgcagcctctggcttcatcttcagtagctataaaatgcactgggtccgccaggctccaggcaaggggctggagtggggtggcacttatttcatatgatggaaggaacagatacttcgcagactccgtgaagggccgagtcaccatctccagagacaattcctaagaacacggtgtctctgcaagtgaatagctgagacgtgacgacacggctgtgtattactgtgcgagagagggtttcgcagctcgtccggcgggcccagttgaacatgactatacactactacc

SEQ ID NO: 534829 - DNA, 478 bp, Homo sapiens
  misc_feature: HEFZJCU01DKOVO.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctaggatacaccttcaccgcctactatatgcactgggtgcgactggcccctggacaagggcttgagtggatgggatggatcgaccctaacagcgtggcacaaagtatgcacagaagtttcagggcagggtcaccatgaccagggacacgtccatcagcacgtccatcagacacagcctacatggacctgagcggctgacatctgacgacacggcgtactattctgtgcgaggt

SEQ ID NO: 534830 - DNA, 540 bp, Homo sapiens
  misc_feature: HEFZJCU01D5PL3.8.25.C03.1.454.heavy.3.raw
  modified_base (508)..(508): a, c, t, g, unknown or other
  modified_base (513)..(513): a, c, t, g, unknown or other
ctcgcgtgtccacgaccggtgctcgatttagtagtgtagatttgggtttggggggagaggagccccagccgtgagattcccaggagtttccacttggtgatcagcactgaacacagaccaccaaccatggagtttgggcttacctgggttttccttgttgctattttaaaaggtgtccagtgtgaggtgcagctggtggactctgggggaggcttggtacagccagggcggtccctgagactctcctgtacagggactggattcatctttggtgactatgctgtgacctgggtccgccaggctccagggaaggggctggagtgggtaagtctcattagaagtaaagcttatggtgggacaacagattacgccgcgtctgtgaaaggcagattcaccatctcaagagatgattccaaaagcatcgcctttctacaaatggacagcctgaaaaccgaggacaacaggcgtgtattactgcaacaggtttggtcgggaaatccgacaaatnacctntgggccagggaaccctggtcaccgtct

SEQ ID NO: 534831 - DNA, 527 bp, Homo sapiens
  misc_feature: HEFZJCU01CM103.17.34.D01.1.454.heavy.3.raw
  modified_base (58)..(58): a, c, t, g, unknown or other
cgtagactagcacgaccggtgctcgatttagatcgtctgtgttgggtttggggatcanaaaacaaccagattcctcctctaaagaagcccctggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgacagcctgtcatctgagacacgggcttctacttctgtgcgaggagtattactataacactgctcctttttacacctccttgacttactggggccatggaaccccggtaccg

SEQ ID NO: 534832 - DNA, 515 bp, Homo sapiens
  misc_feature: HEFZJCU01B33AS.51.12.B01.1.454.heavy.3.raw
cgatcgtatacacgaccggtgctcgatttagtagtgtagattccgcggggggagcatcacccagcaaccacatctgtcctctagagaaccccctgagagccccgctcctcaccatggactggacctggaggatcctcttcttggtggcagtagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacaccgtccatcgccacaacttacatggaactgaccagtctgacatttgacgacacggccgtctattactgtgcgacagaagcggcggacagaggttcgcttactggttcgaggctctccccagtacg

SEQ ID NO: 534833 - DNA, 530 bp, Homo sapiens
  misc_feature: HEFZJCU01A414J.16.27.C05.1.454.heavy.3.raw
  modified_base (423)..(423): a, c, t, g, unknown or other
  modified_base (486)..(486): a, c, t, g, unknown or other
  modified_base (520)..(520): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagacagggtgtttcnccaagtgattgatctgagaagtgaggacacggctgtttattactgtgcgcggtggctggaccnctcttgactacgtgggggccggggagccccggtnactcgtctcc

SEQ ID NO: 534834 - DNA, 547 bp, Homo sapiens
  misc_feature: HEFZJCU01E14XX.17.28.C06.1.454.heavy.3.raw
  modified_base (434)..(434): a, c, t, g, unknown or other
  modified_base (443)..(443): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctanaactgaacngcctgagagtcgcagacacggccgtgtattacgtgtgcgagactgtaggaaaaagtatggctgtgtttagttagggggcctaggggacgccccgtggctacccg

SEQ ID NO: 534835 - DNA, 513 bp, Homo sapiens
  misc_feature: HEFZJCU01D2X4K.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggtttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctcccaggcaagggattggagtgggtggcagttgtttcatctgagggcagtgttcaatggtatgcagactccgtgaagggccgattcaccatctccagagacaattccaggaacacaatgtatttgaaatgaacagcctaagtcctgaggacacgggtgtatactactgtacgaggagggggaaccgagacggagtcaagtatcctttgacgtcgtggggcc

SEQ ID NO: 534836 - DNA, 518 bp, Homo sapiens
  misc_feature: HEFZJCU01A6SF9.12.25.C03.1.454.heavy.3.raw
  modified_base (515)..(515): a, c, t, g, unknown or other
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctgggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattacctgtgaggagagtacgtagcggctcgtctttgacttactggggcctgggaactctggtcaccgtntcc

SEQ ID NO: 534837 - DNA, 497 bp, Homo sapiens
  misc_feature: HEFZJCU01B1Z0D.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagtccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactggacctcgtgacgtacacgggccatgtattactgtcggaagagacgttaggtggctaccgcggggctcgacc

SEQ ID NO: 534838 - DNA, 509 bp, Homo sapiens
  misc_feature: HEFZJCU01CXEU7.10.38.D05.1.454.heavy.3.raw
  modified_base (478)..(478): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatcgcacaatctgagagtcgacgacacggccacctattattgtgcgcgacangactacgctcaattcgtaggggccagggacg

SEQ ID NO: 534839 - DNA, 521 bp, Homo sapiens
  misc_feature: HEFZJCU01C3TKX.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttagtttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctcggggccaagggaccg

SEQ ID NO: 534840 - DNA, 531 bp, Homo sapiens
  misc_feature: HEFZJCU01DF0Q3.7.78.H01.1.454.heavy.3.raw
  modified_base (518)..(518): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggcacgggaaccctggtcaccgtctcctcancctccaccaaggg

SEQ ID NO: 534841 - DNA, 388 bp, Homo sapiens
  misc_feature: HEFZJCU01DNZ4Y.13.61.F06.1.454.heavy.3.raw
tcacgtactacacgaccggtgctcgatttagctacgctctaagggaaaggggctggagtgggtggccaacataaaggaggatgggagtcagacatattatgtggagtctgtgcggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctctgggggcacagcgccctggctgcctggtcagactactcctagtacgtga

SEQ ID NO: 534842 - DNA, 510 bp, Homo sapiens
  misc_feature: HEFZJCU01BX2YH.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccgttcggggaccctgtccctcaattgctttgtctctggaacttctatcaagggtagcagcttccactggggctggatccgccagcccccaggaaagggggctccaatgcgttggacatgtcaattcttatgggcgctcccactacagtgcggccctccagagtcgagcccctcatatccatagacacgtccaagaaccagttttccctgacgctgacgtctgtgaccgccgcagacacggctgtctattattgtgcgagactagccttctgtagtgggggtacttgtcaacccggggatactactccaccttcggcttggaca

SEQ ID NO: 534843 - DNA, 502 bp, Homo sapiens
  misc_feature: HEFZJCU01B38CM.52.15.B04.1.454.heavy.3.raw
cgcagtacgacacgaccggtgctcgatttagacagtatatatccgcggggagctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggaggcgtggtccagcctgggaggtccctgagactctcctgtgcaggctctgcatttcccttcaataactatgctatcgattgggtccgccaggctccaggcaagggactggagtgggtggcagtaatatcagctgatggaggcactaaatattacgctgattctgcgaggggccgattcaccatatccagagacaactccccaagatgtgatatatctacaatagaacagacctgagacctgaggacgacggcctgtagtatttaatttgttgtcgttcgaggggggtcac

SEQ ID NO: 534844 - DNA, 548 bp, Homo sapiens
  misc_feature: HEFZJCU01B3WE8.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagtttccctgacgctgacgtctgtcgaccgccgcagacacggctgtctattattgtgtcgagactagcctttctcgtaggttggggggtactttgccgaaaccccggggtattacctacctacccaccgtttcgggctttacgggacattcgttggggggcccgac

SEQ ID NO: 534845 - DNA, 525 bp, Homo sapiens
  misc_feature: HEFZJCU01BVEE7.3.71.G05.1.454.heavy.3.raw
agacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaaggcctggagtgggtctcgaggtattacttggaatagtgataacatcggctatgcggactctgtgaagggccgattcaccatctccagagacaacgccaagaactcctgtatctgcaaatgaacagtctgagacctgaggacacggaccttgtactttactgtagtaaaggtcccggggtaaatagtagtacgtagtttttggtaactttac

SEQ ID NO: 534846 - DNA, 516 bp, Homo sapiens
  misc_feature: HEFZJCU01EO8DU.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactacgtggggtcctgggaactcgtggtcaccgtct

SEQ ID NO: 534847 - DNA, 534 bp, Homo sapiens
  misc_feature: HEFZJCU01AZS7R.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcggtccctatcgttgacacaccaaactacgcacagaagttccagggcagactcaccataaccgcggacaattaacgaacacagttaatctggagctgaacagcctgtcatctgaggacacgggcttctacttctgtgcgaggagtaattactataacactgctcctttttacaccttcccttgtacttctggggtccagtggaaccccggtccg

SEQ ID NO: 534848 - DNA, 489 bp, Homo sapiens
  misc_feature: HEFZJCU01EY1G0.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggcgattcatcatctccagagacaactccaacaacacactggatctccaaatgaacagcctgagagtcgaggacacggccgtatattagttgtgcccttagtattacta

SEQ ID NO: 534849 - DNA, 497 bp, Homo sapiens
  misc_feature: HEFZJCU01C2IO5.40.82.H05.1.454.heavy.3.raw
tctagcgactcacgaccggtgctcgatttagtcgagctctctcgcgggcacgaccggtgctcgatttagtagtgtagattcgcggggccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaacaccctgagcaactactacatacactggatgcggcaggcccctggacaggggtttgagtggatgggggtggatcaaccctaccagaggtgggcacaaagtatcgacagaactttcaggggcaggggtcaccatgacctgggacgcgtccatcagcacagtctacatggatctgagcgggactggacctcgtcgacgtacaacggcc

SEQ ID NO: 534850 - DNA, 499 bp, Homo sapiens
  misc_feature: HEFZJCU01D1MWM.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtggactac

SEQ ID NO: 534851 - DNA, 485 bp, Homo sapiens
  misc_feature: HEFZJCU01AQZ9C.48.38.D05.1.454.heavy.3.raw
agtatacatacacgaccggtgctcgatttagtatctgatagttgggtttggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggccccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagat

SEQ ID NO: 534852 - DNA, 492 bp, Homo sapiens
  misc_feature: HEFZJCU01AYMB0.51.37.D04.1.454.heavy.3.raw
cgatcgtatacacgaccggtgctcgatttagtagcatactgttgggtttggggacccaaaaaccacacccctccttgggagaatcccctagatcacagctcctcaccatggactggacctggagcatccttttcttggtggcagcagcaacaggtgcccactcccaggttcagctggtacagtctggagctgaagtgaagaagcctggggcctcagtgaaggtctcctgcaaggcctctggttacacctttatgaattatggtatcagctgggtgcgccaggcccctggacaagggcttgagtggatgggatggatcagcgcttacactggtgacacaaagtatgcacagaaactccagggcagagtcaccatgaccacagacacgtccacgagcacagcctacactggaactgaggagcctgggatctgacgacacggccgtgtattactgtgcgagagataggcccaggggagagtagtggttttcaccg

SEQ ID NO: 534853 - DNA, 502 bp, Homo sapiens
  misc_feature: HEFZJCU01AZX6G.12.79.H02.1.454.heavy.3.raw
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaatctcctgcaagtcttctggttacgcactcaccgccaatggtatcagctggctgcgacaggcccctggacaaggtcttgagtggatgtcatggatcagcacgtttcaatggagacacaaagtatggagagaacttccagggcagagtcaccatgaccactgacagatcaacgaacatagcctacttggaactgaggggtcctgaggtctgacgacacggcccctctattatttagtgcgagaattaattttcgttattgttctggtgtgtgtgttcaatgttt

SEQ ID NO: 534854 - DNA, 518 bp, Homo sapiens
  misc_feature: HEFZJCU01B3DM6.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacgctgtctattattgcgcgagagagacacacgaacctactggccaatactatgggggcttgttcgtggggccaggggaccctggtcatcgtcctccccagcctccaccaggccatcgtcttcccctggcg

SEQ ID NO: 534855 - DNA, 532 bp, Homo sapiens
  misc_feature: HEFZJCU01EJC2K.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggacaaatatggttcagggtagttcgactacgtggggaccaggggaaccctggtacaccgtctccctccagccgtccaccgaacggg

SEQ ID NO: 534856 - DNA, 509 bp, Homo sapiens
  misc_feature: HEFZJCU01A3GCT.53.14.B03.1.454.heavy.3.raw
cgcgtatacacacgaccggtgctcgatttagtgtgagtagttccgcgggcctggcgcacccaatggatagcatgggtactgagggtgtatccagaagcctggcaggaaaccttcactgaggccccaggcttcttcgcctcagccccagactgcacaagctggacctgggagtgggcacctgtggctgctgccaccaaaagaggatcctccaggtccagtccatggtgaggcgttgtgctctgggggcttctgaggagggatgtggttgttgggtcagcgctggcaatggtgacagacactattcacagaagttccagggcagagtcaccatcaccagggacacatccgcgagcacagcctacatggaactgagcagcctgagatctgaacgacacgggtgtatattactgtgcgagagggaagtgggatatgtagatgcgccaggtgcccggcccggcccccttactttcgactacgtcgggggccggggaaccctgggtccaccggtt

SEQ ID NO: 534857 - DNA, 471 bp, Homo sapiens; identical to SEQ ID NO: 464107
  misc_feature: HEFZJCU01BZU9W.15.1.A01.1.454.heavy.3.raw

SEQ ID NO: 534858 - DNA, 527 bp, Homo sapiens
  misc_feature: HEFZJCU01EJR4P.13.76.G10.1.454.heavy.3.raw
  modified_base (499)..(499): a, c, t, g, unknown or other
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaaagaacacgctgtttcttcaaatgaacagcctgagagccgatgacacggccgtgtattactgtgcgagagatggggcccacggaaccgttactacgctanggtacgtcgtggggaccaaggggacccg

SEQ ID NO: 534859 - DNA, 501 bp, Homo sapiens; identical to SEQ ID NO: 447123
  misc_feature: HEFZJCU01E0SGE.3.20.B09.1.454.heavy.3.raw

SEQ ID NO: 534860 - DNA, 517 bp, Homo sapiens
  misc_feature: HEFZJCU01DKBLR.51.21.B10.1.454.heavy.3.raw
cgatcgtatacacgaccggtgctcgatttagtgtcgtcgcaagggggagggcatcatccaacaaccacatcccttctctacagaagcctctgagaggaaagttcttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctatttttatgtactgggtgcgacaggccccctggacaaggccttgagtggatgggaaagatcaaccctagtggtggtaccacaagttacgcccagaaattccagggcagagtctccatgaccagaaatacgtccgcgaggacagtctacatggagttgagcagcctgagaactgacgacacggccatatattactgtgcgagagaccttgctggttccttttgtacttctggggccagggaacccctggtctacccg

SEQ ID NO: 534861 - DNA, 522 bp, Homo sapiens
  misc_feature: HEFZJCU01CYWYR.51.86.H09.1.454.heavy.3.raw
cgatcgtatacacgaccggtgctcgatttagtgctatagacttgggtttgggcagggtttggggggaagaggaagactgacggtcctcccaggagttcaggtgctgggcaccgtgggcatgggggaggcgtggtccagcctgggaggtccctgagactctcctgtgcagcctctggattcaccttcaatacttatggcatgcactgggtccgccagggctccaggcaaggggctggagtggctgtcctttatctcatatgatggaggcaataaaattatgcagactccgtgaagggccgattcaccatctccagagacaattccaagaacactctatatttgcagatgaatagcctgagaattgaggacacggctgtgtattactgtgtgagagggtcggcatattccggttttggagtaattatctactgggaacttttgatatctggggtccacggggacaatggtcaccgtcgtcttcagcttccaccaagggcccatccgtctcccctggccgcctcg

SEQ ID NO: 534862 - DNA, 484 bp, Homo sapiens
  misc_feature: HEFZJCU01D4YJP.40.83.H06.1.454.heavy.3.raw
tctagcgactcacgaccggtgctcgatttagatcacgtgcgtcgcggggggggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccactgtctggtcggatgaaagttatgcatactatgcagactctctgaggggccgattcatcatctctagagacaattcgaagaacacggcttatctgcaaatgaacagcctgacagtcgaggacacggctgtatatttctgtgcgtaatggagggtaa

SEQ ID NO: 534863 - DNA, 507 bp, Homo sapiens
  misc_feature: HEFZJCU01DI6SD.51.86.H09.1.454.heavy.3.raw
cgatcgtatacacgaccggtgctcgatttagtgctatagacttgggtttgggctatagacttgggtttggggggaagaggaagactgacggtcctcccaggtgtccagtgtcaggtgcagctggtggactctgggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaattatgcagactccgtgaagggccgattcaccatctccagagacaattccaagaacactctatatttgcagatgaatagcctgagaattgaggacacggctgtgtattactgtgtgagagggtcggcatattccggtttttggaggtaatttatcttactgggaacttttgatatctggggccacgggacaatggtcaccgtcctcttcagcttccacccaa

SEQ ID NO: 534864 - DNA, 547 bp, Homo sapiens
  misc_feature: HEFZJCU01EVH4C.17.28.C06.1.454.heavy.3.raw
  modified_base (402)..(402): a, c, t, g, unknown or other
  modified_base (505)..(505): a, c, t, g, unknown or other
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggtactctgtgaagggccgtttcaccatctccagngacaacgccaagaattcactgtatctacaactgaacagcctgagagtcgcagacacggccgtgtattactgtgcgagatgtggaaaaagtaagtggctggttntttaagttgggggccaggggacgccccttgggtcccacggtt

SEQ ID NO: 534865 - DNA, 496 bp, Homo sapiens
  misc_feature: HEFZJCU01E0BQ1.11.38.D05.1.454.heavy.3.raw
cgagagataccacgaccggtgctcgatttagtatctgatagttggggtctggggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttcccctggcaccctcctccaagagcacctctggggggcacagcgggccctgggcgtgcctggtcaaggactacttccgtatctctcg

SEQ ID NO: 534866 - DNA, 527 bp, Homo sapiens
  misc_feature: HEFZJCU01A319A.7.71.G05.1.454.heavy.3.raw
cgtgtctctacacgaccggtgctcgatttagtgtcgtcgcaagagagaggggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccggtgaagggccgattcaccatctccagagacaattccaggaacacaatgtatttggaaatgaacagcctaagtcctgaggacgacgggtgtatactactgtacgaagggaggggggaaccaggcgggagttccgaagtactcctttgacgtcgtc

SEQ ID NO: 534867 - DNA, 521 bp, Homo sapiens
  misc_feature: HEFZJCU01DW8FJ.13.25.C03.1.454.heavy.3.raw
tcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctggggcctcagtgaaggtctcctgcaaggcttccggatacaccctcaatggaaactatgtccactatgtgcgacaggccccaggacaagggcttctgtggatggggtggatcaaccctaatagtggtgacacaaactatgagaagaaatttgagggccgggtcaccatgaccagggacacgtccatcaatacagccttcatggaactgaccagactgacctctgacgacacggccgtgtattactgtgcggtcgaaactcagcctaactactttgaattttggggccagggagccctggtcaccgtct

SEQ ID NO: 534868 - DNA, 518 bp, Homo sapiens
  misc_feature: HEFZJCU01AGWIR.52.35.D02.1.454.heavy.3.raw
cgcagtacgacacgaccggtgctcgatttagcacacgatagttgggtttggggagctctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatcctccagagacgagtccaggaacagcctgtttcttcaaatggacagtctgagacctgacgacacggctgtctattactgtgcgagacgaacccgaggggggcgggagcaggccccgtaacttc

SEQ ID NO: 534869 - DNA, 513 bp, Homo sapiens
  misc_feature: HEFZJCU01CI67E.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccggggacagacttaccatgacccacgaactcctccataaacacacgcctacatggagttgagggagcctgacatctgacgacacggccgtctattactgtgcgagagtcccacgatccggtgagcctacgggcaggcggccctttgactttcgtc

SEQ ID NO: 534870 - DNA, 498 bp, Homo sapiens
  misc_feature: HEFZJCU01DBSZK.10.29.C07.1.454.heavy.3.raw
catagtagtgcacgaccggtgctcgatttagagtgctacgaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggaactccccttcagtacctagtggcatgcactgggtccgccaggctccaggcaaggggctaggagtgggtggcagccatatcgtatgatgtaactaataaatactatgcagactccgtgaagggccgattcaccatctccagagacaattcaagaacacgctgtttctgcaaatgaacagcctgagagctggaggacacggctggtgtattactgtgcgaaagatatcgcggtagtaa

SEQ ID NO: 534871 - DNA, 399 bp, Homo sapiens
  misc_feature: HEFZJCU01C6WZE.4.77.G11.1.454.heavy.3.raw
agcactgtagcacgaccggtgctcgatttagctagtcactcaagggaaaggggctggaatggctttcatacattactagcagtggtacagcatactacgcagagtctctgcagggccgattcaccatctccagggacaacgccaagaactcgctatatctggaaatgaacagcctgagagtcgaggacacggccctgtattactgtgcgagagaccgaggaagggcagtggctggatccgttagggtttttgacaactggggacagggaaccctggtcaccgtctcctcggcctccaccaagggcccatcggtcttccccctggcgccctgctccaggagcacctccgagagcacagcggccctgggctgcctggtcaaggactacttcctacagtgct

SEQ ID NO: 534872 - DNA, 526 bp, Homo sapiens
  misc_feature: HEFZJCU01EUOAX.48.42.D09.1.454.heavy.3.raw
agtatacatacacgaccggtgctcgatttagacacatacgcagggaaagggggctttctgagagtcagggatctcatgtgcaagaaaatgaagcacctgtggttcttcctcctgctggtggcggctcccagatgggtcctgtcccagctgcagctgcaggagtcgggcccaggactggtgaagccgttcggagaccctgtccctcacctgcactgtctctggtggctccatcagcagtagtagttactactggggttggatccgccagcccccagggaaggggctggagtggattgggagtatgcactataagtgggagcacccactacaccccgtccctcaagagtcgagtcaccatatccgtagacacgtccaagaatcagttctccctgaagctgacctctgtgaccgccgcagacacggctgtttattactgtgtgagacgggtgccccaagaaaacgtgttttaatcccgtggggccaggggaaaccctcggtcaccggtctcccgtcacgccctccaccc

SEQ ID NO: 534873 - DNA, 492 bp, Homo sapiens
  misc_feature: HEFZJCU01DN14T.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatggctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctggggcacagcggccctggggctgcctggtcaaggactacttccgagtgcgtct

SEQ ID NO: 534874 - DNA, 518 bp, Homo sapiens
  misc_feature: HEFZJCU01AIT1S.22.73.G07.1.454.heavy.3.raw
acatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaagggactggagtggattgggtatatctattacactgggagcaccgactacagcccctccctcatgagtcgagtcaccatttcactagacacgtccaagaaccagttctccctgaaactgaggtctgtgaccgctgcggacacggccgtctattactgtgcgagatttgctttttggagttggttacgccgcgttttgactactggggccagggaaccctggtcaccgtctcctcagcctccaccaac

SEQ ID NO: 534875 - DNA, 519 bp, Homo sapiens
  misc_feature: HEFZJCU01CWIPT.16.10.A10.1.454.heavy.3.raw
  modified_base (472)..(472): a, c, t, g, unknown or other
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaactttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaagggcccatcggtcttcccctggcaccctcctccaagagcacctctgggggcncagcggccctgggctgctggtcaggactacttccgagtagtactacg

SEQ ID NO: 534876 - DNA, 527 bp, Homo sapiens
  misc_feature: HEFZJCU01E1V1V.10.35.D02.1.454.heavy.3.raw
catagtagtgcacgaccggtgctcgatttagcacacgatagttgggtttgggggggagaggagccccagccctgggattcccaagtgtcttcattcagtgatcagtactgaacacagaggactcaccatggagtttgggctgaggtggattttccttgctgcaattttaaaaggtgtccagtgtgacgtgcagttggtggagtctgggggaggcttggttaagccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagacgtccaacgaagactgtgggaagggacgtgctggggcca

SEQ ID NO: 534877 - DNA, 521 bp, Homo sapiens
  misc_feature: HEFZJCU01DJ49H.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgatttctgtgcgagtcttgatagtagtggttatccttgaatactggggccagggaaccctggtgaccgtctcctcagcctccaccaagggcccatcggtcttcccctggcgccctgctccaggagcacctccgagagcacaggcggccc

SEQ ID NO: 534878 - DNA, 533 bp, Homo sapiens
  misc_feature: HEFZJCU01A6GSQ.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtcccgccggcaagggactggagtatattggacgaatctatgccagtgggaccgcatctacaacccgtccctcaagagtcgagtcagcatgtcagtcgaccacgtcccagaaccagttcctccctgacagtgagttatatgaccgccgcagacacggccgtgtattactgtgcgagagaggccgttattttacggaccagcttagttaaaaacctcccttaacttaccggtctggacgtcgtcggggaccgacggggaacc

SEQ ID NO: 534879 - DNA, 539 bp, Homo sapiens
  misc_feature: HEFZJCU01C61TY.17.28.C06.1.454.heavy.3.raw
  modified_base (468)..(468): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtntattactgtgcgagatgtaggaaaaagtatggctgtgtttagttggggccaggggacgccctggtccaccg

SEQ ID NO: 534880 - DNA, 508 bp, Homo sapiens
  misc_feature: HEFZJCU01DC4L5.48.81.H04.1.454.heavy.3.raw
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggccccctggacacgggcttgagtggatgggatcgatcatccctttctctaatgtcacaagatacacacagagattccagggcagaatcacacttaccgcggacaaatccacgggcacagcgcagttggacctgagcggcctgagaccgtgaggacgacggccatttactactgtgcggcggggaggtggacggagctcggttttcggagttatcatctactactttg

SEQ ID NO: 534881 - DNA, 503 bp, Homo sapiens
  misc_feature: HEFZJCU01C233K.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtggtcagcggctttgacggtaaggcacagtatgcaccgaagatgaagggcagagtcacgattaccacggacacccccacgaacacagtctacatgcaactgacgagcctgagagctgacgacacggccgtctattactgtagcgagaattgttttctgtcatcgtacaatttgataggctctatggactggacttcgtc

SEQ ID NO: 534882 - DNA, 501 bp, Homo sapiens
  misc_feature: HEFZJCU01BGGS8.17.27.C05.1.454.heavy.3.raw
cgtagactagcacgaccggtgctcgatttagacgcgatcgaagggtttggggacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgagggtctccgtgcaaggcttctgcaggcacctttagcaactatgctttcagctgggtgcgacaggcccctggacaagggcttgagtggatgggagggatcattcctatccttgggacagtaaggtatccacagaagttccagggcaaagtcaccattaccgcggacgaatccacgagcacagcctacattgagttgagcagcctcagatctgagacacggccgtgtattactgtgcgagagggtccggagacacatggcagtagtgggaatgtatgttttgta

SEQ ID NO: 534883 - DNA, 523 bp, Homo sapiens
  misc_feature: HEFZJCU01B14Y0.12.33.C11.1.454.heavy.3.raw
  modified_base (491)..(491): a, c, t, g, unknown or other
atacgacgtacacgaccggtgctcgatttagagtgagctcgttgggtttgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtacggccgggggggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagtagccctcggcagaagtntggactactactattatggtatggacgtcgtc

SEQ ID NO: 534884 - DNA, 503 bp, Homo sapiens
  misc_feature: HEFZJCU01B0HZY.51.78.H01.1.454.heavy.3.raw
cgatcgtatacacgaccggtgctcgatttagtgtgagtagtttgggtttggggctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccgcaagctccagggaagggcctggagtgggtctcacgtattagttggaatagtggtagtatagcctatgcggactctgtgaagggccgattcaccatctccagagacaacgccaagaactccctagtactctgcaaatgaacagtctgagagctgaggacacggccttgtattactgcgcaaagccaaggcaacagctggtactac

SEQ ID NO: 534885 - DNA, 536 bp, Homo sapiens
  misc_feature: HEFZJCU01C1PAM.7.78.H01.1.454.heavy.3.raw
  modified_base (471)..(471): a, c, t, g, unknown or other
  modified_base (518)..(518): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggtcggtttgtcttctccatggatacctctgtcgggacggcttatctgcagataaccaaccttcaacctgacgacactgccgtttattttgtacgagagcgtcgtctgtcngtggaattgactactggggccacgggaacctggtccaccgtctcctnacgcctcccaccgaaggg

SEQ ID NO: 534886 - DNA, 330 bp, Homo sapiens
  misc_feature: HEFZJCU01D03AY.48.80.H03.1.454.heavy.3.raw
agtatacatacacgaccggtgctcgatttagctgtgcgtcgaagggaaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctggggcacagcggccctgggctgcctggtcaaggactacttcctatgtatact

SEQ ID NO: 534887 - DNA, 525 bp, Homo sapiens
  misc_feature: HEFZJCU01EUPBR.9.34.D01.1.454.heavy.3.raw
tgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacgacggccattttattttcttgtcggcgaagggaggccatatggggaagtacgtattttcgatccctccg

SEQ ID NO: 534888 - DNA, 541 bp, Homo sapiens
  misc_feature: HEFZJCU01BHVUC.13.28.C06.1.454.heavy.3.raw
  modified_base (450)..(450): a, c, t, g, unknown or other
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctgggggggtccctgagactctcctgtgtagcctctggatttgtttttagtgactattggatgagttgggtccgccaggctccagggaaggggctggagtgggtggccaacataaagtacgatgaagttgagataaattatttggactctgtgaagggccgattcaccatctcgagggacaacgccaagaactcgctgtatctgcaaatggagagcctgagngccgaggacacggctggtatattattgtgtgagattagtcgacacttactttggactacgtggggccacggggaaccctggtccaccggtt

SEQ ID NO: 534889 - DNA, 388 bp, Homo sapiens
  misc_feature: HEFZJCU01DMSAA.49.26.C04.1.454.heavy.3.raw
agtcgagagacacgaccggtgctcgatttagtctagcgactttgggtttgggtcgtggagtgggtctctcttattaattgggatggtggtatcaccgactatgcagactctgtgaagggtcgattcaccatctccagagacaacagcagaaactccctgtatctgcaaatgaacagtctcagaggtgaggacaccgccttctactactgtgcaaaagattacggtgaccacacctattttgaccactgcggccagggaaccctagtcaccgtctcctcagcctccaccaagggcccatcggtcttccccctggcaccctcctccaagagcacctctgggggcacagcgccctgggctgcctggtcaaggactacttcctctctcgact

SEQ ID NO: 534890 - DNA, 393 bp, Homo sapiens
  misc_feature: HEFZJCU01D4UFL.7.60.F05.1.454.heavy.3.raw
cgtgtctctacacgaccggtgctcgatttagtacgtcatcagggaaaggggctggagtgggtctcagtgatttatagtagttccagttcatttcacgcagactccgtgaagggccgattcaccatctccagagacatttccaagaacacggtggatcttcagatggacagcctcagagcggaggacacggctgtctattactgtgtgagaggcgccaccggtggggatggaaacgattttcttgtttgtctggggccagggaaccctggtcaccgtctcctcagcctccaccaagggcccatcggtcttccccctggcgccctgctccaggagcacctccgagagcacagcggccctgggctgcctggtcaaggactacttcctagagacacg

SEQ ID NO: 534891 - DNA, 506 bp, Homo sapiens
  misc_feature: HEFZJCU01BNXRP.48.23.C01.1.454.heavy.3.raw
agtatacatacacgaccggtgctcgatttagtacacgtgattagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgcgcagacacggctgtctattactgtgcgaggcccgagcgcagtgcttttgatgcctttgatatgtggggccgaagggacgaatggtacaccgttcg

SEQ ID NO: 534892 - DNA, 385 bp, Homo sapiens
  misc_feature: HEFZJCU01BFR0C.49.57.F02.1.454.heavy.3.raw
agtcgagagacacgaccggtgctcgatttagctcgatatagttgggtttggggtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctatttttgaccacttgcggccagggaacccctagtcaccgtctcctcagcctccaccaagggcccatcggtcttccccctggcaccctcctccaagagcacctctgggggcacagcggccctgggctgcctggtcaaggactacttcctctctcgact

SEQ ID NO: 534893 - DNA, 524 bp, Homo sapiens
  misc_feature: HEFZJCU01BUBRO.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtataaaaccaaactgatggtggacaacagactacgctgcacccgtgaaaggcagattcaccatctcaagagatgattcaaaagcacgctgtatctgcaatgaacagctgagaacgaggacacagccgtgtattactgtaccacataccctgaaacgcgtcaactactactactacggtatggacctcgt

SEQ ID NO: 534894 - DNA, 510 bp, Homo sapiens
  misc_feature: HEFZJCU01CNAY7.22.36.D03.1.454.heavy.3.raw
acatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccggtctacttctgtgcgaaagacctctattttgggccgcggccgtacg

SEQ ID NO: 534895 - DNA, 503 bp, Homo sapiens
  misc_feature: HEFZJCU01EQA9U.48.32.C10.1.454.heavy.3.raw
  modified_base (486)..(486): a, c, t, g, unknown or other
agtatacatacacgaccggtgctcgatttagtatagacatcaacacacaaaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggaggcttggtccagccgggggggtccctgagactctcctgtgcagcctctggactcacctttagtacctattggatgacctgggtccgccaatctccagggagggggctggagtgggtggccaacataaagggagatggaagtaagacatactatgcggattctgtgaagggccgattcaccatctccagagacaacgccaaggagtcactgtatctgcagatgaacagcctgagagccgaggacgcggctgtgtattactgtgcgagngatgtgaatccctttgt

SEQ ID NO: 534896 - DNA, 551 bp, Homo sapiens
  misc_feature: HEFZJCU01B5UHN.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtggtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtagtaggcttggtgttttagttgggggaccaggggacgtccccgtggtcctaccc

SEQ ID NO: 534897 - DNA, 493 bp, Homo sapiens
  misc_feature: HEFZJCU01C9FUM.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtggaggggccgattcagcatctccagagacaacggcaagagtatactgtatctggaaatgaacaatctagagagtcgacgatacggctgtctatcattgtgtttcgatgccttcggtccgcggacttc

SEQ ID NO: 534898 - DNA, 489 bp, Homo sapiens
  misc_feature: HEFZJCU01AYNR7.19.71.G05.1.454.heavy.3.raw
tactctcgtgcacgaccggtgctcgatttagtgtcgtcgcaagagagaggggggcagagtctgctgaattctggttgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctggggaaggacatatttcatgtaccaacacgtggaatacaaattatgcaccatctgttgagagtcgactgacaatcaacgtagacacatcgaagaaccagttctccctgcagctgacctctgtgactcccgaggacgacgggtgtatattactgtaggaagacggtccccatagac

SEQ ID NO: 534899 - DNA, 506 bp, Homo sapiens
  misc_feature: HEFZJCU01CUPXI.10.12.B01.1.454.heavy.3.raw
catagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaaggggctggaatggatgacagttatttcacacgatgcaaccaaaacatactacgcggagttcgtgaggggccgctgcatcgtctccagagacaattcgaagaacactctgtacctgcaaatgaacagtctgagagccgaggacacggccgtctacttttgtgcgactagaagtgggagctataggggatttgg

SEQ ID NO: 534900 - DNA, 521 bp, Homo sapiens
  misc_feature: HEFZJCU01B1V76.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggacgcaccctccgaggacgcacagcggccccgtgggcctc

SEQ ID NO: 534901 - DNA, 508 bp, Homo sapiens
  misc_feature: HEFZJCU01AX95Y.26.37.D04.1.454.heavy.3.raw
agactatactcacgaccggtgctcgatttagtagcatactgttgggtttggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggagcaggtagtggagtctgggggaggcgtggtccagcctggggggtccctgagactctcctgtgcagcctctggattcaccttcagtacctacgccatgcactggatccgccaggctccaggcaaggggctagagtgggtggctctatatcatatgatggaagttaatgaacattacgcagactccgtgaagggccgattcaccgtctccagagacaattccaagagcacgattgtttctgcaaatgaacagcctagagagttgaggacacgggtgtcttatttctgtgcgcgaggtccggtggaggggtgtccga

SEQ ID NO: 534902 - DNA, 510 bp, Homo sapiens
  misc_feature: HEFZJCU01BWNFF.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcactgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtggttattacttgtgacggaaagtatttactatagtaggtggacggtac

SEQ ID NO: 534903 - DNA, 545 bp, Homo sapiens
  misc_feature: HEFZJCU01ACXRU.17.28.C06.1.454.heavy.3.raw
cgtagactagcacgaccggtgctcgatttagagctcacgtattgggtttggggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactcccagggaaggggctggagtgggtggccaacataaagcaaggatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaagtatggctgtgtttagttggggccgagggacgccctggtcaccgtctccctcgacgcctacccg

SEQ ID NO: 534904 - DNA, 493 bp, Homo sapiens
  misc_feature: HEFZJCU01CM3SE.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcactgacacgcctgagaactgacgacacgtctctctactactgtgcgagagagttgacgacgtct

SEQ ID NO: 534905 - DNA, 529 bp, Homo sapiens
  misc_feature: HEFZJCU01ED8SD.48.2.A02.1.454.heavy.3.raw
agtatacatacacgaccggtgctcgatttagactcatctacagggggagtctccctcactgcccagctgggatctcagggcttcatttttctgtcctccaccatcatggggtcaaccgccatcctcgccctcctcctggctgttctccaaggagtctgcgcggaagtgcgcctggtgcagtctggagcagtggtgaagaggcccggggagtctctaaagatctcctgtcagggttctgaaggcgactttgacaccttctgggtcgcctgggtgcgccagaggcccggtaaaggactagagtatatgggcgtcatctatcctggtgactccgataccatatatactccgtcgtttcaaggccaggtcaccatgtctgccgacaagtccaagactgtcgcctacctccactgggccaaactgacgtcctccgacagcgccacttattactgtgcgagggtaggcactacgtcgttggggtcgagaggacaactggttcgtaccccgtcggggccgagggaacccgtcggtc

SEQ ID NO: 534906 - DNA, 511 bp, Homo sapiens
  misc_feature: HEFZJCU01A7A5B.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagccgtggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcacccatctcaagagatgattcagagaactcactttatctgcaatgaacagcctgagaaccgacgacacggccgtacgtattattgtgtcatagacctaggatacgaacgac

SEQ ID NO: 534907 - DNA, 523 bp, Homo sapiens
  misc_feature: HEFZJCU01BKN2S.12.86.H09.1.454.heavy.3.raw
atacgacgtacacgaccggtgctcgatttagtgctatagacttgggtttggggggaagagggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgccgagtcttgatagtagtggttatcctgaatactggggccagggaaccctggtgaccgtctcctcagcctccacaacgggccatcggtcttcccctggcgccctgctcaggagcacctccgagagcacagcggcctggg

SEQ ID NO: 534908 - DNA, 550 bp, Homo sapiens
  misc_feature: HEFZJCU01B0QHJ.21.78.H01.1.454.heavy.3.raw
tcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcattttacttcgaccccttgggggacccgggggaacccttgggtaccacccggtctcccccacccctcccacccaaacc

SEQ ID NO: 534909 - DNA, 541 bp, Homo sapiens
  misc_feature: HEFZJCU01DDHCD.17.28.C06.1.454.heavy.3.raw
  modified_base (484)..(484): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgcccgtagttttacgtggactctgtgaagggccgtttcaccatctccagagacaacgccaagaattcactgtatctacaactgaacagcctgagagtcgcagacacggccgtgttattactgtgcgngatgtaggaaaagtaatggctgtgtttattggggccaggggacgccgtggtctaccg

SEQ ID NO: 534910 - DNA, 496 bp, Homo sapiens
  misc_feature: HEFZJCU01D6PTL.12.75.G09.1.454.heavy.3.raw
  modified_base (464)..(464): a, c, t, g, unknown or other
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgaggtctcctgcaaggcttctggaggcaccttcaacaactatgctgtcagctggatgcgacaggccccctggacaagggcttgagtggatggggaggagtcatccctctctttcgttcagcagactacgcacagaaattccaggacagagtcacgattaccgcggacgaatccacgaccacagcctacatagagctgcgcacgcctgagatctgaagacacggccatttattactgtgcgagagatgcagggccctcccacatcggtttatttctttgacttccnggggtccaggggaaccctggccaccgtctcct

SEQ ID NO: 534911 - DNA, 525 bp, Homo sapiens
  misc_feature: HEFZJCU01DTY2F.48.53.E09.1.454.heavy.3.raw
agtatacatacacgaccggtgctcgatttagagagagtgtgttgggtttgggggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttcgaccccgtgggggccaggggactaccgtggtccaccgtctcctcagccttccaccaac

SEQ ID NO: 534912 - DNA, 540 bp, Homo sapiens
  misc_feature: HEFZJCU01DSREJ.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatcctcaagagatgattcaaaagcacgctgtatctgcaaatgaacagcctgagaaccgaggacacagccgtgtattactgtaccacactccctgaaagcgtacaactactactactacggtatggacctcgtcggggaccg

SEQ ID NO: 534913 - DNA, 516 bp, Homo sapiens
  misc_feature: HEFZJCU01A3KNB.10.87.H10.1.454.heavy.3.raw
catagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtctgggggaggcgtggtccagcctggggggtccctgagactctcctgtgcagcctctggattcgacttcgaaatgtctggcatgcactgggtccgccaggctccaacgaaggggctggagtgggtggcagttctttcatttgatgaaaaaagggatattatgcgacctccgtgaagggccgattcagcatctccagagacatttccaaggccacggtgtatctgcaaatgaccagcctgagaagtgaggacacggctatgtactattgtgcgaaggaccttccacctgaaactaatatagggggctttaggacac

SEQ ID NO: 534914 - DNA, 503 bp, Homo sapiens
  misc_feature: HEFZJCU01EH6MU.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcaggggtctccatgaccagggacaggggccatcagaacagcctacatggagctgaacagactgacatctgacgacaccggtccgtttattattgtgtgagaggacggacccgagtcgaaccgtcc

SEQ ID NO: 534915 - DNA, 509 bp, Homo sapiens; identical to SEQ ID NO: 444586
  misc_feature: HEFZJCU01DO3BD.12.78.H01.1.454.heavy.3.raw

SEQ ID NO: 534916 - DNA, 494 bp, Homo sapiens
  misc_feature: HEFZJCU01ETYRG.49.27.C05.1.454.heavy.3.raw
agtcgagagacacgaccggtgctcgatttagacgcgatcgaagggtttggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagcgtagaagacgacggctgtatattactgtagacgtaacttaactacg

SEQ ID NO: 534917 - DNA, 499 bp, Homo sapiens
  misc_feature: HEFZJCU01BLAGL.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaagggctggagtgggtctcatccattagtagtaataggtgcctacagatactacgcagactcactgaagggccgactcaccatctccagagacaacgccaagaactcactgtatctgcaaatgaacagcctgagagccgaggacacggctgtgtattactgtgcgagaggagctattatctggaacccgat

SEQ ID NO: 534918 - DNA, 513 bp, Homo sapiens
  misc_feature: HEFZJCU01BZ4IH.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcacttttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacgtt

SEQ ID NO: 534919 - DNA, 491 bp, Homo sapiens
  misc_feature: HEFZJCU01B2R22.52.19.B08.1.454.heavy.3.raw
cgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgatcaggctgagagctgaagacacggtctttaatattactgtgacgtaactttaatcacggaac

SEQ ID NO: 534920 - DNA, 506 bp, Homo sapiens
  misc_feature: HEFZJCU01BWYX4.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattacctgtgcgagagtcccagatccgggtgacgcctacggcagcggcctttgacttcgtc

SEQ ID NO: 534921 - DNA, 476 bp, Homo sapiens
  misc_feature: HEFZJCU01D70N4.12.81.H04.1.454.heavy.3.raw
atacgacgtacacgaccggtgctcgatttagtagtgtagattcgcgggggggtccctgagactctcttgtgcaggctctggactcagcattagcaattatgccgtgagctgggtccgccaggttgcaggaaagggtctggaatgggtctcagtaattagtcatagtggtgatgtcacactctacgcggactccgtgaagggccggttcaccatctccagagacaattccaagaacacagtgtatttgcaaatgaacagcctgaaagccgatgacacggccatatattattgtgtgagagatgacgaaagcgaatatccattcgatcttgactactggggccagggaaccctggtgaccgtctcctcagcctccaccaagggcccatcggtcttcccctggcgccctgctccaggagcacctccgagagcacagcggccctgggctgcctggtcaaggactacttcctacgtcgtat

SEQ ID NO: 534922 - DNA, 404 bp, Homo sapiens
  misc_feature: HEFZJCU01E1FIP.22.80.H03.1.454.heavy.3.raw
acatacgcgtcacgaccggtgctcgatttagctgtgcgtcgaagggaaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgaggacctcatacgattttttggagtggttatttcccccctcctgactactgggccagggaaccctggtcaccgtctcctcagcctccaccaagggcccatcggtcttccccctggcaccctcctccaagagcacctctgggggcacagcggccctgggctgcctggtacaaggactacttccacgcgtatgt

SEQ ID NO: 534923 - DNA, 510 bp, Homo sapiens
  misc_feature: HEFZJCU01BCN40.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggcccagggaaccctggtcaccgtctcctcagcctccaccaagggcccatcggtcttcccctggcaccctcctccaagagcacctctgggggcacagcggccctgggctgcctggtcaaggactacttcctacgtcgtat

SEQ ID NO: 534924 - DNA, 526 bp, Homo sapiens
  misc_feature: HEFZJCU01AT1ZC.9.28.C06.1.454.heavy.3.raw
tgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcatcccccaggaaaggccctggaatggcttgcattcgtttattggaatgatgataaacgctacagcccatctctgaggaccaggctcaccattaccaaggacaccctccaaaaaccaggtggtccttacaatgaccaacatggaccctgtggacacagccacatattactgtgcacacagtgtcatgactgcggtgactgttctcccctttggcttactggggccaggggaaccccttgggtcaccggtctccctcacgcctccaccaacgggcccacg

SEQ ID NO: 534925 - DNA, 514 bp, Homo sapiens
  misc_feature: HEFZJCU01CXN4Z.52.28.C06.1.454.heavy.3.raw
cgcagtacgacacgaccggtgctcgatttagagctcacgtattgggtttgggggcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtggatggggtggaacaatcccaacagtggaggcaccggtcgcacagaatatgcgcggaagtttcagggcagggtcaccatgaccagcgacaggtccactaacacagcctacatggagctaagtagactgacatctgacgacacggccgtctattattgtgtgagagaggacccgatgaccgtcgaacatggacgtcgtggggccac

SEQ ID NO: 534926 - DNA, 523 bp, Homo sapiens
  misc_feature: HEFZJCU01DLA6H.10.85.H08.1.454.heavy.3.raw
catagtagtgcacgaccggtgctcgatttagtatcactcagtcgcgggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactacttgtgggctctgtgaagggccgattcaccatctccagagacaacgccaagaagtcactgtatctgcaaatgaacgatgtgagagtcgaggacacggctgtatatttctgtgcgaggggagccggctagtgggttcggacctcgtcggggccaggggtaacccg

SEQ ID NO: 534927 - DNA, 532 bp, Homo sapiens
  misc_feature: HEFZJCU01A5W03.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccagggggaccctggtcatcgtctccccagcctccaccaacgggcccatcggtccttcccctggccgcccgtcg

SEQ ID NO: 534928 - DNA, 507 bp, Homo sapiens
  misc_feature: HEFZJCU01DMYLV.11.19.B08.1.454.heavy.3.raw
  modified_base (502)..(502): a, c, t, g, unknown or other
cgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccagggaaggggctggagtgggtttcatacatttctaggtaattctggtaccatacactatgcagtctctgtgaagggccgattcaccatctccagagacaacgccaggaactcactttatctgcaaatgagcagcctgagagtcgaggacacggggtatttattactgtgtcgagagatagtctagtctatgcttccggggancgtaa

SEQ ID NO: 534929 - DNA, 480 bp, Homo sapiens
  misc_feature: HEFZJCU01ASGZC.12.75.G09.1.454.heavy.3.raw
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctccctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccggcggacgaatccacgaccacagcctacatagagctgcgcagcctgacgatctgaagacacggccatttattactgtgcgagagagtgcacgggccctcccac

SEQ ID NO: 534930 - DNA, 445 bp, Homo sapiens
  misc_feature: HEFZJCU01DAXMZ.10.11.A11.1.454.heavy.3.raw
catagtagtgcacgaccggtgctcgatttagctacgactgcagggtgtacacctgtggttctcggggccgccggaaagggcccggagtggcttggtcggatctctctcactgggaacaccctatacaacccctctttcatgggtcgactctccctttcactggacctgtctgagaaccagttctccatgacactgacctctgtcatcgccgctgacacggccgtctatttctgcgcgtcctcatcccttattcatcatgatggttctacttattattacgagagatctgagtttgaccactggggccagggcatgctagtcaccgtctccccagcctccaccaagggcccatcggtcttccccctggcaccctcctccaagagcacctctgggggcacagcggccctgggctgcctggtcaagggactacttcccactacctatg

SEQ ID NO: 534931 - DNA, 509 bp, Homo sapiens
  misc_feature: HEFZJCU01BCHRN.10.38.D05.1.454.heavy.3.raw
  modified_base (478)..(478): a, c, t, g, unknown or other
catagtagtgcacgaccggtgctcgatttagtatctgatagttgggtttggggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctgggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacntgactacgctcaattctggggccaggggacg

SEQ ID NO: 534932 - DNA, 506 bp, Homo sapiens
  misc_feature: HEFZJCU01BC9W1.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattccaccatctccagagacaacgccaagaactcactgtatctgcaaatgaacagcctgagacgccgaggacacggctgtgtattactgtgcgtagtttgtttggggcgggatagcagcggtaccc

SEQ ID NO: 534933 - DNA, 520 bp, Homo sapiens
  misc_feature: HEFZJCU01B8NCV.12.85.H08.1.454.heavy.3.raw
  modified_base (497)..(497): a, c, t, g, unknown or other
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtgaggacacggccctttattactgtgcgaaggatcgccctatatggtgctggntcggggagtttggttccgtgggg

SEQ ID NO: 534934 - DNA, 514 bp, Homo sapiens
  misc_feature: HEFZJCU01DIQNW.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacacgcctgagagccgacgacacggccatatattactgtgcgaaagcaccggcagttagtcacccatactactttgactaccgtggggaccg

SEQ ID NO: 534935 - DNA, 516 bp, Homo sapiens
  misc_feature: HEFZJCU01APX58.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgcatctacaacccgtcctcaagagtcgagtcagcatgtcagtcgacacgtcccagaaccagttctccctgacagtgagttatatgaccgccgcagacacggccgtgtattactgtgcgagagaggcgttagtttagaccagctagttaaaactcctactacggtctggacgtcgtgggccgaggggaccaac

SEQ ID NO: 534936 - DNA, 505 bp, Homo sapiens
  misc_feature: HEFZJCU01DMB9W.19.86.H09.1.454.heavy.3.raw
tactctcgtgcacgaccggtgctcgatttagtgctatagacttgggtttgggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcaataaagtggttcgtaccccg

SEQ ID NO: 534937 - DNA, 500 bp, Homo sapiens
  misc_feature: HEFZJCU01CSE4H.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccagggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccgagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaaggggaccacggtcaccgtctcctcagcctccacc

SEQ ID NO: 534938 - DNA, 503 bp, Homo sapiens
  misc_feature: HEFZJCU01CBXBT.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctgggccaagggacactggtcaccgtctcttcagcctccaccaaggccatcggtcttcccctggcgcctgctccaggacg

SEQ ID NO: 534939 - DNA, 342 bp, Homo sapiens
  misc_feature: HEFZJCU01BZ098.47.38.D05.1.454.heavy.3.raw
agctcacgtacacgaccggtgctcgatttagtatctgatagttgggtttcagggcagggtcaccatgaccagggacacgtccatcagtaacagcctacatggagctgagcagtctgagacctgacgacacggcccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcgacctctgggggcacagcggccctgggctgcctggtcaaggactacttcctacgtgagct

SEQ ID NO: 534940 - DNA, 528 bp, Homo sapiens
  misc_feature: HEFZJCU01EPO1E.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaacccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactatggggccagggaaccctggtcaccgtctcctcacgcctccacc

SEQ ID NO: 534941 - DNA, 505 bp, Homo sapiens; identical to SEQ ID NO: 447076
  misc_feature: HEFZJCU01BQDSB.10.38.D05.1.454.heavy.3.raw

SEQ ID NO: 534942 - DNA, 495 bp, Homo sapiens
  misc_feature: HEFZJCU01B555N.14.59.F04.1.454.heavy.3.raw
cgtctagtaccacgaccggtgctcgatttagtacacacacttagggattgggggggagaggagcccagcactagaagtcggcggtgtttccattcggtgagcagcactgaacacagaggactcaccatggagtttgggctgagctgggttttcctcgctgctcttttaagaggtgtccagtgtcaggggcagctggtggagtctgggggaggcgtggtccagcctgggaggtccctgagactctcctgtgcagcgtctggattcaccttcagaaactctggcatgcactgggtccgccaggctccaggcaaggggctggagtgggtgcacttatatggtatgatggaagtaatgaaaactatgcagctccgtgaagggccattcaccatctccagagacaattccaagaacacagtgtatctgcaaatgagcagcctgagagtcgaggacacggctgtgtattactgtgcgagagattgtttttatgggttcggg

SEQ ID NO: 534943 - DNA, 491 bp, Homo sapiens
  misc_feature: HEFZJCU01DAY02.13.86.H09.1.454.heavy.3.raw
tcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctgggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaattacttaa

SEQ ID NO: 534944 - DNA, 506 bp, Homo sapiens; identical to SEQ ID NO: 446520
  misc_feature: HEFZJCU01BDHVB.10.38.D05.1.454.heavy.3.raw

SEQ ID NO: 534945 - DNA, 530 bp, Homo sapiens
  misc_feature: HEFZJCU01CM867.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagcgatgacacggccgtgtattactgtgcgagagatgggggcccacgaacgttactacgctatggacgtcgtggggccgaacgggaccaac

SEQ ID NO: 534946 - DNA, 516 bp, Homo sapiens
  misc_feature: HEFZJCU01AIKF6.13.11.A11.1.454.heavy.3.raw
tcacgtactacacgaccggtgctcgatttagctacgactgcagggggggacacagcctactctgaggcatcccttccagaagtcactatacagtaggagacatgcaaatggggtcctccctctgccgatgaaaaccagcccagccctgaccctgcagctctgggagaggagccccagccctgagattcccacgtgttgccattcggtgatcagcgctgaacacagaggactcgccatggagtttgggctgagctgggtttccttgttgctattttaaaaggtgtccagtgtgaggtgcagctggtagagtctgggggaggtgtggtacggcctggggggtccctcagactctcctgtgcaacctctggattcagatttgatgagtatggcatacactgggtccgccaacctccagggagggctgcagtggtctctggtataaactggaatggtgccagcacaactttatgcacgactcgttgtggaacggggccgagtttccaccctatcctaccg

SEQ ID NO: 534947 - DNA, 522 bp, Homo sapiens
  misc_feature: HEFZJCU01DSIFR.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctggggtccgtcagcccccaggaaaggccctggagtggcttgcactcatttattgggatgatgtgaagtactacagtccatatttcaagaggctcactatcaccaaggacacttccaaaaccaagtggtcctgacaatgaccaacgtgaagcctgcggacacggccacatattattgtgcacaccgacgctataccgccagctagggaatcgacaactggttcgacccctggggccagggaacccgttgtcaccgtctcctcagcctccaccaacgggccctacg

SEQ ID NO: 534948 - DNA, 532 bp, Homo sapiens
  misc_feature: HEFZJCU01BMLIS.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttattgggccagggagcctggtcaccg

SEQ ID NO: 534949 - DNA, 509 bp, Homo sapiens
  misc_feature: HEFZJCU01DLJSY.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactgtgcgagagattgggccgacggaaccttgactactgggccagggaaccctggtcaccgt

SEQ ID NO: 534950 - DNA, 523 bp, Homo sapiens
  misc_feature: HEFZJCU01DFTCO.51.27.C05.1.454.heavy.3.raw
cgatcgtatacacgaccggtgctcgatttagacgcgatcgaagggtttgggggggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgagggcagggctgtttattactgtgtgcgatccgacctcactggtaccggggagttacttcctccgcaacgggtatggacgttcgg

SEQ ID NO: 534951 - DNA, 481 bp, Homo sapiens
  misc_feature: HEFZJCU01C9R5L.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgacgagcacagcggccctgggctgcctggtcaaggactacttccacgcgtatgt

SEQ ID NO: 534952 - DNA, 519 bp, Homo sapiens
  misc_feature: HEFZJCU01ELDMM.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttctcaaatgaacagcctgagagccgatgacacggccgtgtattactgtgcgagagatggggcccacgaacgttactacgctatggacgtcgtggggccaagggacccg

SEQ ID NO: 534953 - DNA, 503 bp, Homo sapiens
  misc_feature: HEFZJCU01DLRSE.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccaacggaccacccccacgaacacagtctacatgcaactgacgagcctgagagctgacgacacggccgtctatactgtgcgagaattgttttctgtcatcgtacaatttgataggctctatggactggacttcgt

SEQ ID NO: 534954 - DNA, 521 bp, Homo sapiens
  misc_feature: HEFZJCU01EWFBA.14.25.C03.1.454.heavy.3.raw
  modified_base (55)..(55): a, c, t, g, unknown or other
cgtctagtaccacgaccggtgctcgatttagtagtgtagatttgggtttgggctnagctgggttttcctcgttgctcttttaagaggtgtccagtgtcaggtgcagctggtggagtctggggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccccgtcggggccgacgggaacccgtggtcaccgtctcctccagcctcccaccgaacgggcccatccggtccttcccccgtc

SEQ ID NO: 534955 - DNA, 500 bp, Homo sapiens; identical to SEQ ID NO: 489044
  misc_feature: HEFZJCU01C9OPD.11.71.G05.1.454.heavy.3.raw

SEQ ID NO: 534956 - DNA, 497 bp, Homo sapiens
  misc_feature: HEFZJCU01D8XN8.17.36.D03.1.454.heavy.3.raw
cgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtaccgcctggggggtccctgagactctcctgtagagcctctggattcgccttcagtacctacagcatgaactgggtccgccaggttccagggaagggtctggagtgggttgcatacattagagtagcgatagtccatatactacgcagactctgtgaagggccgattcaccatctccagagacagtgccaagaactcactgtatctgacaatgaacagaccttagagacgacgaccacggctaggtgttattactgtcggcgaggaagactccgctg

SEQ ID NO: 534957 - DNA, 498 bp, Homo sapiens
  misc_feature: HEFZJCU01DAPYI.3.26.C04.1.454.heavy.3.raw
  modified_base (443)..(443): a, c, t, g, unknown or other
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtgctacgagtactggtacttcgatctctgggcgtggcaccctgctgactgtctcctcagcctccaccaagggcccatcggtcttcccctggcgccctgctccnggagcacctccgagagcacagcggccctgggctgcctcggtcaaggaccttaccg

SEQ ID NO: 534958 - DNA, 519 bp, Homo sapiens
  misc_feature: HEFZJCU01CB6BQ.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatctcaaatgaacaacctgagagtcgaagacacggccgtatattactgtgcgagacatgacttcggtgacccctggggccaggggaaccctggtccaccgtctcctca

SEQ ID NO: 534959 - DNA, 539 bp, Homo sapiens
  misc_feature: HEFZJCU01BSQMI.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagattcactgtatctacaactgaacagcctgagagtcgcagacacggccgtgtattactgtgcgagatgtaggaaaaagtatggctgtgttttagttggggccaggggagcccctggtccaccg

SEQ ID NO: 534960 - DNA, 523 bp, Homo sapiens
  misc_feature: HEFZJCU01DDALQ.12.40.D07.1.454.heavy.3.raw
atacgacgtacacgaccggtgctcgatttagtgatagagcgtaacaacagagggctcaccatggagtttgggctgagcgtgggttttcctcgttagctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggcc

SEQ ID NO: 534961 - DNA, 506 bp, Homo sapiens
  misc_feature: HEFZJCU01A12JR.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctaggggccagggac

SEQ ID NO: 534962 - DNA, 536 bp, Homo sapiens
  misc_feature: HEFZJCU01BAQUP.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccggcgggggtcacccaaattgactactggggccagggaaccctggtcaccgtctcctcagcctccaccaacgggcccacgtcggtccttccccctcgggccgccctcgcctccgac

SEQ ID NO: 534963 - DNA, 532 bp, Homo sapiens
  misc_feature: HEFZJCU01BZUS3.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccggattcaccatctccagagacaacgccaagaactccctgtttctgcaaatggacaatttgagagaggaagacacggccttatatttctgtgcgagagccctcggcagaagtctggactactactattatggtatggacgtctggggccgaagggaccacggtcatcgtctcctcagcctccaccaacgggcccatcggtcctttccccctcggccaccctccctccaacgagcacctctcggggggcacg

SEQ ID NO: 534964 - DNA, 454 bp, Homo sapiens
  misc_feature: HIJSMM301CFQRQ.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 534965 - DNA, 477 bp, Homo sapiens
  misc_feature: HIJSMM301B31KR.4.24.C02.1.454.light.4.raw
  modified_base (446)..(446): a, c, t, g, unknown or other
  modified_base (448)..(448): a, c, t, g, unknown or other
  modified_base (457)..(457): a, c, t, g, unknown or other
  modified_base (460)..(460): a, c, t, g, unknown or other
agcactgtagcacgaccggtgctcgatttagtacagatcgttagggaaaggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattatgtcaacaatataacagttattgacgtgtcagacgagagagananagactgtgngtncacactactcgtcttct

SEQ ID NO: 534966 - DNA, 486 bp, Homo sapiens
  misc_feature: HIJSMM301BMN2R.3.12.B01.1.454.light.4.raw
agacgcactccacgaccggtgctcgatttagtagtgtagattccgcggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccacccttctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaacgaactgtggctgcaccat

SEQ ID NO: 534967 - DNA, 492 bp, Homo sapiens
  misc_feature: HIJSMM301A3FR1.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgtcttcat

SEQ ID NO: 534968 - DNA, 355 bp, Homo sapiens
  misc_feature: HIJSMM301EWLG8.3.11.A11.1.454.light.4.raw
agacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccacgacaggttcagtggcagtgggtcgtgggacagacttcactctcaccatcagcagactggagcctgaagattttgcagtgtattactgtcaggtctatggttactcacctcggttcagctttggccaggggaccaaggtggagatcaaacgaactgtggctgcaccatctgtcttcatcttcccgccatctgagagtgcgtct

SEQ ID NO: 534969 - DNA, 506 bp, Homo sapiens
  misc_feature: HIJSMM301BRIAL.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcaccatctgtt

SEQ ID NO: 534970 - DNA, 499 bp, Homo sapiens
  misc_feature: HIJSMM301C56IQ.14.55.E11.1.454.light.4.raw
  modified_base (425)..(425): a, c, t, g, unknown or other
  modified_base (455)..(455): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgtaacttactactgtcaacagagttacagtacccccncctacttcgttcggacggacggaacgaggngaagtcacgacgaaccgtagtggtcgtcgcaccaactcttcgtc

SEQ ID NO: 534971 - DNA, 441 bp, Homo sapiens
  misc_feature: HIJSMM301CQPLU.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 534972 - DNA, 508 bp, Homo sapiens
  misc_feature: HIJSMM301BV8MI.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtgtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccgaaaataagaggtcgaaacgaactgtggcgtgcaccactctgtcttctatt

SEQ ID NO: 534973 - DNA, 456 bp, Homo sapiens
  misc_feature: HIJSMM301AJU07.19.86.H09.1.454.light.4.raw
  modified_base (112)..(112): a, c, t, g, unknown or other
  modified_base (246)..(246): a, c, t, g, unknown or other
tactctcgtgcacgaccggtgctcgatttagtgctatagacttgggtttggggccttcctgggcccagtctgtgctgactcaggcaccctcagcgtctgggacccccggcanacggtcaccatcgcttgttctgcaagcagctcgaacatcgggagcagtggtgtgatgtggtatcagaaagtcccaggaacggcccccaaactacgtcatctataatgacgctgagcggtccttaagggtccctnaccgattctctggcgagaggtctggcggcctcagcttccctggccatcagagggctccagtctgaagatgaggctgattattactgtgcaatctgggagtgacagtgtgaacggtccggtttcggtcggagggaccgaagctgacgtcctacgtacagcccaacggctgcccctccggtcgactctgttccaccctcctccacgagagta

SEQ ID NO: 534974 - DNA, 414 bp, Homo sapiens
  misc_feature: HIJSMM301C997Y.41.15.B04.1.454.light.4.raw
tctatactatcacgaccggtgctcgatttagacagtatatatccgggcacgaccggtgctcgatttagagtgagctcgttgggtttggggaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatatagtataga

SEQ ID NO: 534975 - DNA, 474 bp, Homo sapiens
  misc_feature: HIJSMM301AXWRZ.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcag

SEQ ID NO: 534976 - DNA, 493 bp, Homo sapiens
  misc_feature: HIJSMM301AYD45.52.83.H06.1.454.light.4.raw
cgcagtacgacacgaccggtgctcgatttagatcacgtgcgtcgcgggcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttctaccatcagcggcccgtgcagcctcgaagatattgcaacatattactgtcaacagtatggtaatctcccacctcactttcggtcggagggaccgaaggtcgagatcaaacgaaactgtggctgcaccatctgtcttcta

SEQ ID NO: 534977 - DNA, 485 bp, Homo sapiens
  misc_feature: HIJSMM301ENYVN.15.28.C06.1.454.light.4.raw
tctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcatt

SEQ ID NO: 534978 - DNA, 502 bp, Homo sapiens
  misc_feature: HIJSMM301B9YJB.12.18.B07.1.454.light.4.raw
atacgacgtacacgaccggtgctcgatttagtcgctgcgtaaggggaggaactgctcagttaggacccacgagggaaccgatggaagccccacgctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagaccctggccaggctcccaggctcctcatctatgatacattgaagagggccactggcatctcaggcagattcaatggcagtgggtctgggacagacttcactctcaccctcaccagcctagagcctgaagattttggaatttattactgtcaacagcgtagcaactggcctcccactttcggcggagggaccaaggtggagatcaagcgaactgtggctgcaccatctgtcttcatcttcccgcca

SEQ ID NO: 534979 - DNA, 497 bp, Homo sapiens
  misc_feature: HIJSMM301BDTM7.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagatttgcagtgtattattgtcagcaatatggtaggtcacctgggtactttggtccgaggggaccgaagctggagatacaaacgaactgtggctgcaccatctgtctt

SEQ ID NO: 534980 - DNA, 503 bp, Homo sapiens
  misc_feature: HIJSMM301A4L45.14.55.E11.1.454.light.4.raw
  modified_base (454)..(454): a, c, t, g, unknown or other
cgtctagtaccacgaccggtgctcgatttagcactcgcacgttgggtttgggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctacttcgttcggacggacgaacgacggnggatacacgacgaactagtggtcgtcgcaccaacctacttcgtcttctt

SEQ ID NO: 534981 - DNA, 500 bp, Homo sapiens
  misc_feature: HIJSMM301BTE8S.16.53.E09.1.454.light.4.raw
tgtactactccacgaccggtgctcgatttagagagagtgtgttgggtttggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtgggatccaggcacagattttactactgaaaatacagcagagtggaggctgaggagtgttgggtttagttactgcatgcaagctctacaaactaccttacctactttgtccgagggaccgaagcgtgagatacaaacgaaactgt

SEQ ID NO: 534982 - DNA, 497 bp, Homo sapiens
  misc_feature: HIJSMM301DAG43.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaacgaactgtggctgcaccatctgtcttcatcttcccgccat

SEQ ID NO: 534983 - DNA, 504 bp, Homo sapiens
  misc_feature: HIJSMM301BLT4N.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtcaaacgaactagtggctgcaccatctgtcttcatcttccccg

SEQ ID NO: 534984 - DNA, 492 bp, Homo sapiens
  misc_feature: HIJSMM301BPEV2.40.78.H01.1.454.light.4.raw
tctagcgactcacgaccggtgctcgatttagtgtgagtagtttgggtttggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccggactgttctatacagcttcaacaataagaactctgtggcttggtaccagcacaaaccaggacagcctcccaagctgctcattgactgggcatctacccggggatccggggtccctgaccgattcagtggcagcgggtctgggacagatttcactctcaccatcaccagcctgcaggctgaagatgtggcggtttattactgtcaacaatattctggtcaatctcattctttcggcggagggaccaaggtggagatcagacgaactgtggctgca

SEQ ID NO: 534985 - DNA, 499 bp, Homo sapiens
  misc_feature: HIJSMM301AMS5W.19.71.G05.1.454.light.4.raw
tactctcgtgcacgaccggtgctcgatttagtgtcgtcgcaagagagagggtgaggtacaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctaccccggggaatccggggtccctgaccgattcagtggcagcgggtctggggaacagattttcactctcaccatcagcagcctgcaggctgaagatgtggcagtttattattgtcaacaatattattatacttcgtggacggttcggccaagggaccgaaggtggatatcagacgaactgtgg

SEQ ID NO: 534986 - DNA, 494 bp, Homo sapiens
  misc_feature: HIJSMM301C821H.47.64.F09.1.454.light.4.raw
agctcacgtacacgaccggtgctcgatttagcgcgtatacaagggggaggaactgctcagttaggacccagagggaaccatggaagccccacgctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccgagggtggagatcaaacgaactgtggctgcaccatctgtcttcat

SEQ ID NO: 534987 - DNA, 496 bp, Homo sapiens
  misc_feature: HIJSMM301CMNR9.48.3.A03.1.454.light.4.raw
agtatacatacacgaccggtgctcgatttagagagcgtcacaggggagtcagacccagtcaggacacagcatggacatgagggtccccgctcagctcctggggctcctgctgctctggctcccaggtgccaagtgtgccatccagatgacccagtctccttccaccctgtctgcatctgtgggagacagcgtcaccatcacttgccgggccagtcagaatattaatgactggttggcctggtatcaacagaaaccagggaaagcccctaaacttctgatctttcaggcatctaatttagaacatggggtcccatcaaggttcagcggcagtgggtttggcacagacttcactctcaccatcgccagcctgcagcccgatgattttgcaacttatttctgccaacaatacaccactttgtggacgtcgtcgggaccggaacgtaggagagtcaagacgaactagtggcgtcgcaccaactctgtcttcactcttccc

SEQ ID NO: 534988 - DNA, 499 bp, Homo sapiens
  misc_feature: HIJSMM301DCN4D.15.26.C04.1.454.light.4.raw
tctacgtagccacgaccggtgctcgatttagtctagcgactttgggtttgggtcagactcagtcaggacacagcatggacatgagggtccccgctcagctcctggggctcctgctgctctggctcccaggtgcccaagtgtgacatccgagagtgaacccgagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcaat

SEQ ID NO: 534989 - DNA, 493 bp, Homo sapiens
  misc_feature: HIJSMM301BWVO4.3.31.C09.1.454.light.4.raw
agacgcactccacgaccggtgctcgatttagacgtctcatcaaggaaggaaggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggaggaccaaggtggagatcaaacgaactgtggctgcaccatctgtctt

SEQ ID NO: 534990 - DNA, 382 bp, Homo sapiens
  misc_feature: HIJSMM301DNWHR.41.26.C04.1.454.light.4.raw
tctatactatcacgaccggtgctcgatttagtctagcgactttgggtttggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 534991 - DNA, 490 bp, Homo sapiens
  misc_feature: HIJSMM301DTXZ0.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccggggaccaaggtggatctcaaaagaactgtggctgcacca

SEQ ID NO: 534992 - DNA, 494 bp, Homo sapiens
  misc_feature: HIJSMM301DSS7G.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 534993 - DNA, 444 bp, Homo sapiens
  misc_feature: HIJSMM301BVJN9.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccgccctcctccgtgtctgat

SEQ ID NO: 534994 - DNA, 494 bp, Homo sapiens
  misc_feature: HIJSMM301DOVZA.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 534995 - DNA, 498 bp, Homo sapiens
  misc_feature: HIJSMM301AYOX3.10.33.C11.1.454.light.4.raw
catagtagtgcacgaccggtgctcgatttagagtgagctcgttgggtttggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcggggacggacgtaggaggtactaacgaactagtggcgtcgcaccactctgtcttctat

SEQ ID NO: 534996 - DNA, 490 bp, Homo sapiens
  misc_feature: HIJSMM301BK3AU.7.75.G09.1.454.light.4.raw
cgtgtctctacacgaccggtgctcgatttagtatagacatcagggggcaggagtcagacccacgtcaggacacagcatggacatgagggtccccgcctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctaggggcagatttcactctcaccatcaatcacctgcaggctgaggattttgcaacttactactgtcagcaggctaacaggctgcccccaaccttcggccagggacgacgactggagattaaacgaactgtggctgcaccactctgtt

SEQ ID NO: 534997 - DNA, 434 bp, Homo sapiens
  misc_feature: HIJSMM301D10OZ.10.38.D05.1.454.light.4.raw
catagtagtgcacgaccggtgctcgatttagtatctgatagttgggtttgggggtgtggtggtctccactccctccgcgtccgggtctcctggacagtcagtcaccatctcctgcactggaaccagcagtgactttgttgcttataactatgtctcctggtaccagcaccacccaggcaaagcccccaaactccttgtttttgtaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccaccctcctccactactatg

SEQ ID NO: 534998 - DNA, 448 bp, Homo sapiens
  misc_feature: HIJSMM301ELS5D.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 534999 - DNA, 381 bp, Homo sapiens
  misc_feature: HIJSMM301EEL5T.41.55.E11.1.454.light.4.raw
tctatactatcacgaccggtgctcgatttagcactcgcacgttgggtttggggaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 535000 - DNA, 492 bp, Homo sapiens
  misc_feature: HIJSMM301CYIJA.27.78.H01.1.454.light.4.raw
agcgtcgtctcacgaccggtgctcgatttagtgtgagtagtttgggtttgggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcaagtgatcaccttcggccaagggacacgactggagattaaacgaactgtggctgcaccatctgtctt

SEQ ID NO: 535001 - DNA, 476 bp, Homo sapiens
  misc_feature: HIJSMM301AFZ0K.48.37.D04.1.454.light.4.raw
agtatacatacacgaccggtgctcgatttagtagcatactgttgggtttggggagtcagacccactcaggacacagcatggacatgagggtccccgctcagcctccgtgggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacattaccctcggacgttcgcaggaccgaagtggagtcaacgaactgtggctgcacca

SEQ ID NO: 535002 - DNA, 461 bp, Homo sapiens
  misc_feature: HIJSMM301BWV2P.5.14.B03.1.454.light.4.raw
atcagacacgcacgaccggtgctcgatttagtgtgagtagttccgcggggagtcagacccagtcaggacacagcatggacatgagggtccccgctcagctcctggggctcctgctgctctggttcccaggagacagacttacgtctcacttgtcgggcgagtcacgatattagtaccaggttagcctggtatcagcagaagccagggaaagcccctaaactcctgatctatgctgcatccagtttgcaaagtggggtcccatcgaggttcagcggcagtggatctgggacagatttcactctcaccatcagcaggctgcagcccgaagattttgcaacttactattgtcaaaatactaacagtctcccgcgcagttttggccaggggaccaaaagtggagatcaaaacgaactgtggctgcaccatctgtcttcatcttcccgccatctgacgtgtctgat

SEQ ID NO: 535003 - DNA, 492 bp, Homo sapiens
  misc_feature: HIJSMM301BLEQT.27.78.H01.1.454.light.4.raw
agcgtcgtctcacgaccggtgctcgatttagtgtgagtagtttgggtttgggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaaggacacgactggagattaaacgaactgtggctgcaccatctgtctt

SEQ ID NO: 535004 - DNA, 494 bp, Homo sapiens; identical to SEQ ID NO: 534994
  misc_feature: HIJSMM301C8WDG.27.78.H01.1.454.light.4.raw

SEQ ID NO: 535005 - DNA, 454 bp, Homo sapiens
  misc_feature: HIJSMM301C107S.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccacgagagta

SEQ ID NO: 535006 - DNA, 484 bp, Homo sapiens
  misc_feature: HIJSMM301EAHC9.46.35.D02.1.454.light.4.raw
actagcagtacacgaccggtgctcgatttagcacacgatagttgggtttggggagctgctcagttaggacccacgagggaaccatggaaaccccacgcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgcagtctattactgtcagcagtatggtcacgtcccaagaacttttggccagggaccaagctggagatcaacgaactgtggctgcaccat

SEQ ID NO: 535007 - DNA, 495 bp, Homo sapiens
  misc_feature: HIJSMM301DYSD7.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcatcttcccgcc

SEQ ID NO: 535008 - DNA, 463 bp, Homo sapiens
  misc_feature: HIJSMM301EATA6.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaagtggagatcaaacgaactgtggctgcaccatctgtcttcatcttcccgccatctgacactactatg

SEQ ID NO: 535009 - DNA, 470 bp, Homo sapiens
  misc_feature: HIJSMM301DECQD.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctctccgagtgccacttttggcgggggaccaaggtggacatcaaacgaa

SEQ ID NO: 535010 - DNA, 303 bp, Homo sapiens
  misc_feature: HIJSMM301BPKRR.13.11.A11.1.454.light.4.raw
tcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccacgacaggttcagtggcagtgggtctgggacagacttcactctcaccatcagcagactggaacctgaagactttgcactttatttctgtcaccagtatggaactgtggctgcaccatctgtcttcatcttcccgccatctgatagtacgtga

SEQ ID NO: 535011 - DNA, 517 bp, Homo sapiens
  misc_feature: HIJSMM301CKOPU.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtcaagtgtgggacaccaacacttgtgtcttcgggactgggaccgagtcaccgtcctaagtcagcccagggccaaccccactgtcactctgttcccaccctcctcgacacg

SEQ ID NO: 535012 - DNA, 494 bp, Homo sapiens
  misc_feature: HIJSMM301BSOPS.26.72.G06.1.454.light.4.raw
agactatactcacgaccggtgctcgatttagctacgactgcaagggaaagggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagacgaactgtggctgcaccatctgtcttcatcttcccg

SEQ ID NO: 535013 - DNA, 483 bp, Homo sapiens
  misc_feature: HIJSMM301EE46K.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccaggggaccaggctggagatcagacgaactgtgg

SEQ ID NO: 535014 - DNA, 500 bp, Homo sapiens
  misc_feature: HIJSMM301EM9EP.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaaggaaccgaaggtgggataatcagacgaactagtggctg

SEQ ID NO: 535015 - DNA, 501 bp, Homo sapiens
  misc_feature: HIJSMM301BDANI.43.34.D01.1.454.light.4.raw
tgtgagtagtcacgaccggtgctcgatttagatcgtctgtgttgggtttggggctttgtcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccactgtcactctgttcccaccctcctcactactcacacg

SEQ ID NO: 535016 - DNA, 503 bp, Homo sapiens
  misc_feature: HIJSMM301CF9HP.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaacggtggaggttactaaacgaaactgtggcgtgcaccactctgtcttctatt

SEQ ID NO: 535017 - DNA, 512 bp, Homo sapiens
  misc_feature: HIJSMM301A3AX3.14.55.E11.1.454.light.4.raw
  modified_base (423)..(423): a, c, t, g, unknown or other
  modified_base (459)..(459): a, c, t, g, unknown or other
cgtctagtaccacgaccggtgctcgatttagcactcgcacgttgggtttgggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagatttgcaacttactactgtcaacagagttacagtacccccncctctacgttcggcggacggaacgacggacggatanacaacgaacgtaacgttggtcggtcgtcgaccaacctacttcgttcgttctta

SEQ ID NO: 535018 - DNA, 485 bp, Homo sapiens
  misc_feature: HIJSMM301A9K74.46.35.D02.1.454.light.4.raw
actagcagtacacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 535019 - DNA, 510 bp, Homo sapiens
  misc_feature: HIJSMM301A3PFX.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctgctactctggctcccagataccaccggagaaactgtgttgacacagtctccaggcaccctgtctttgtctccggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgtcgtccaggaccgaacggtaggaagtcaacgaactagtggcgtgcaccactctgtcttctactcttcccgtcccact

SEQ ID NO: 535020 - DNA, 447 bp, Homo sapiens
  misc_feature: HIJSMM301C2BC6.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 535021 - DNA, 406 bp, Homo sapiens
  misc_feature: HIJSMM301AKR3V.4.35.D02.1.454.light.4.raw
agcactgtagcacgaccggtgctcgatttagcacacgatagttgggtttggggtttcatgagtgcagggagacggccaggattacttgtggggagacaacattggagataaagtagtgcactggtaccagcagaagccaggccaggcccctcctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaaccgtcttaggtcagcccaaggccaaccccactgtcactctgttcccgcccctcctcctacagtgct

SEQ ID NO: 535022 - DNA, 445 bp, Homo sapiens
  misc_feature: HIJSMM301BHFLF.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgccctccctcgacacgcgag

SEQ ID NO: 535023 - DNA, 476 bp, Homo sapiens
  misc_feature: HIJSMM301BBVLK.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgaactgtggctgcaccatctgtcttcatcttcccccatctgaagtatagtct

SEQ ID NO: 535024 - DNA, 492 bp, Homo sapiens
  misc_feature: HIJSMM301CLOV4.48.4.A04.1.454.light.4.raw
agtatacatacacgaccggtgctcgatttagagtagtgatcaggggagtcagtctcagtcaggacacagcatggacatgagggtccccgctcagctcctggggctcctgctactctggctccgaggtgccagatgtgacatccagatgacccagtctccatcatccctgtctgcatatgtgggggacagagtcaccatcacttgccgggcaagtcagagcattagtaggtatttaaattggtatcatcaaagaccagggatggcccctaacctcctgatctacggtacatccactttgcaaagtggggtccctcaaagttcagcggcagtggctcttggacggatttcactctcaccatcaccagtcttcaggctgaagatttaggaatttactactgtcagcagacttacagtgttccgtacacttttggccagggaccaaactggagatgaaacgaactgtggctgcaccatctgtcttcatcttccccg

SEQ ID NO: 535025 - DNA, 503 bp, Homo sapiens
  misc_feature: HIJSMM301CF6HQ.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggacagcagcactccctatgtcttcggcactgggaccaaggtcaccgtcctaggtcagcccaaggctacgccctcggtcactctgtt

SEQ ID NO: 535026 - DNA, 354 bp, Homo sapiens
  misc_feature: HIJSMM301EE9Y9.19.22.B11.1.454.light.4.raw
tactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttatacaactccaataataagaactacttagcttggttccagcagaaaccaggacagcctcctaagatgctcttttattgggcatctgcccgggaatccggggtccctgaccgattcagtggcagcgggtctgggacagatttcactctcacca

SEQ ID NO: 535027 - DNA, 444 bp, Homo sapiens
  misc_feature: HIJSMM301EBIKQ.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgacacgcgag

SEQ ID NO: 535028 - DNA, 418 bp, Homo sapiens
  misc_feature: HIJSMM301A7YY2.16.46.E02.1.454.light.4.raw
tgtactactccacgaccggtgctcgatttagactcatctacagggaaaggggctgtgcctggggtctcctggacagtcagtcaccatctcctgcactggaaccagcagtgacgttggtagttataaccgtgtctcctggtaccagcacgcccccaggcacacgcccccaaactcatgatttatgaagtcagtaatcggccctcaggggtccctgatcgcttctcgtgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccgccctcctcgagtagtaca

SEQ ID NO: 535029 - DNA, 485 bp, Homo sapiens
  misc_feature: HIJSMM301BYOYA.46.35.D02.1.454.light.4.raw
actagcagtacacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatcaaacgaactgtggctgcaccat

SEQ ID NO: 535030 - DNA, 479 bp, Homo sapiens
  misc_feature: HIJSMM301CCESF.51.26.C04.1.454.light.4.raw
cgatcgtatacacgaccggtgctcgatttagtctagcgactttgggtttgggtgatgttgataccacgaaacatacttagaccccaaattatctccagagcaggtgatggtggctgtctgtcctggggacacggacactgagggtggctgagtcaggtcataggcggccagggatcctgtgcagtaagcaaggacgccgaggaagagagggatggtcagagtggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgcccctcggtcactctgttcccaccctcctctcgtagcact

SEQ ID NO: 535031 - DNA, 468 bp, Homo sapiens
  misc_feature: HIJSMM301BYV81.52.59.F04.1.454.light.4.raw
  modified_base (360)..(360): a, c, t, g, unknown or other
  modified_base (430)..(430): a, c, t, g, unknown or other
cgcagtacgacacgaccggtgctcgatttagtacacacacttagggattggggaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcagtgggtctgggacagattttacnctcaccatcagcagcctgcagcctgaagatgttgcaacttatttctgtcataactatgatgatgcccctnacacgttcggccaagggaccaagctggaaatcaaacga

SEQ ID NO: 535032 - DNA, 501 bp, Homo sapiens
  misc_feature: HIJSMM301CQ3QB.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaagggaccaaggtggaaatcaaacgaactgtggctgcaccatctgtcttcatcttccccg

SEQ ID NO: 535033 - DNA, 494 bp, Homo sapiens
  misc_feature: HIJSMM301C7K0W.4.27.C05.1.454.light.4.raw
  modified_base (491)..(491): a, c, t, g, unknown or other
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtnact

SEQ ID NO: 535034 - DNA, 454 bp, Homo sapiens; identical to SEQ ID NO: 534964
  misc_feature: HIJSMM301C8STE.19.86.H09.1.454.light.4.raw

SEQ ID NO: 535035 - DNA, 497 bp, Homo sapiens
  misc_feature: HIJSMM301BVHI8.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcggggacgaacagtgaggatcaaccgaacctgtggcgtgcaccactctgtt

SEQ ID NO: 535036 - DNA, 384 bp, Homo sapiens
  misc_feature: HIJSMM301CZ7MM.41.26.C04.1.454.light.4.raw
tctatactatcacgaccggtgctcgatttagtctagcgactttgggtttgggggaaagagccacccgtctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 535037 - DNA, 403 bp, Homo sapiens
  misc_feature: HIJSMM301DH0NM.4.35.D02.1.454.light.4.raw
agcactgtagcacgaccggtgctcgatttagcacacgatagttgggtttggggtttcatgagtgcagggagacggccaggattacttgtgggggagacaacattggagataaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgtcactctgttcccaccctcctcctacagtgct

SEQ ID NO: 535038 - DNA, 517 bp, Homo sapiens
  misc_feature: HIJSMM301DAZL6.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaacgggaccgaacggtaggaaggtacaaacgaactagtggcgtgcaccactctgtcttctatcttcccgtccact

SEQ ID NO: 535039 - DNA, 443 bp, Homo sapiens
  misc_feature: HIJSMM301BM6ZP.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctccaggggtcccgtgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 535040 - DNA, 375 bp, Homo sapiens
  misc_feature: HIJSMM301CQHF6.9.11.A11.1.454.light.4.raw
tgatacgtctcacgaccggtgctcgatttagctacgactgcaggggagagagccaccctctcttgcaggaccagtctgcatattcccagcacctacgtagcctggtaccagcagaaacctggccagtctcccaggctcctcatctatggtgcgtccaccagggccactggcatcccagaccgcttcagttccagtgggtctgggacagacttcactctcaccatccgcggactggagcctgaagatttgtcagtttattactgtcagcagtatggtagctcaccgtacacttttggccaggggaccaagctggagatcaaacgaactgtggctgcaccatctgtcttcatcttcccgccatctgaagacgtatca

SEQ ID NO: 535041 - DNA, 507 bp, Homo sapiens
  misc_feature: HIJSMM301BDTOM.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatttcccgccact

SEQ ID NO: 535042 - DNA, 444 bp, Homo sapiens
  misc_feature: HIJSMM301D1KYW.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctccactactatg

SEQ ID NO: 535043 - DNA, 486 bp, Homo sapiens
  misc_feature: HIJSMM301CF6AL.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 535044 - DNA, 503 bp, Homo sapiens
  misc_feature: HIJSMM301C7LNZ.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtca

SEQ ID NO: 535045 - DNA, 504 bp, Homo sapiens
  misc_feature: HIJSMM301B0MJK.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaggtggagtcagcgaactgtggctgcaccatctgtcttcatcttcccgcc

SEQ ID NO: 535046 - DNA, 492 bp, Homo sapiens
  misc_feature: HIJSMM301CRVV9.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggactgtggctgcacatctgtcttcatcttccccg

SEQ ID NO: 535047 - DNA, 493 bp, Homo sapiens
  misc_feature: HIJSMM301D4OFD.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactgtgg

SEQ ID NO: 535048 - DNA, 496 bp, Homo sapiens
  misc_feature: HIJSMM301CFHBT.48.71.G05.1.454.light.4.raw
agtatacatacacgaccggtgctcgatttagtgtcgtcgcaagagagaggggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccacggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatccttcccgccatctgatatgtatact

SEQ ID NO: 535049 - DNA, 481 bp, Homo sapiens
  misc_feature: HIJSMM301DVWOO.14.11.A11.1.454.light.4.raw
cgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtcccatcaaggttcagtggcagtggatctggcacagatttcactctcaccatcagcagcctgcagcctgaagattttgcaacttattactgtctacaagattacaattaccctcgaacgttcggccaagggaccaaggtggaagtcaaacgaactgtggctgcaccat

SEQ ID NO: 535050 - DNA, 495 bp, Homo sapiens
  misc_feature: HIJSMM301AVOG6.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctccgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgt

SEQ ID NO: 535051 - DNA, 498 bp, Homo sapiens
  misc_feature: HIJSMM301AP4GK.12.38.D05.1.454.light.4.raw
atacgacgtacacgaccggtgctcgatttagtatctgatagttgggtttggggaacgtgctcagttaggacccacgacggaaccatggaagccccacgcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccggtcagcagcctgcagtctgaagattttgcagtttattactgtcagcagtatgagaagtggttcaagactttcggcggagggaccgaaggtggagatcaaacgaaactgtggctgcaccatctgtcttcat

SEQ ID NO: 535052 - DNA, 441 bp, Homo sapiens
  misc_feature: HIJSMM301BPK4D.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggtcccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 535053 - DNA, 493 bp, Homo sapiens
  misc_feature: HIJSMM301DDM6T.15.71.G05.1.454.light.4.raw
tctacgtagccacgaccggtgctcgatttagtgtcgtcgcaagagagagggggtcaggctggaactgaggagcagggtggggcacttctccctctaacactctcccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccaccaaggttcagcggcagtgaatctgggacagatttcactctcaccatcagcagcctgcagcctgaggattttgcaacttactattgtcaacaggctaacagtttccctctcactttcggcggagggaccaaggtggatatcaaacgaactgtggctgcacca

SEQ ID NO: 535054 - DNA, 486 bp, Homo sapiens
  misc_feature: HIJSMM301EKT3M.47.70.G04.1.454.light.4.raw
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgt

SEQ ID NO: 535055 - DNA, 504 bp, Homo sapiens
  misc_feature: HIJSMM301CIF6U.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctggaccaaagtggatatcaaacgaactgtggctgcaccatctgtctt

SEQ ID NO: 535056 - DNA, 405 bp, Homo sapiens
  misc_feature: HIJSMM301CBRD2.4.35.D02.1.454.light.4.raw
  modified_base (391)..(391): a, c, t, g, unknown or other
agcactgtagcacgaccggtgctcgatttagcacacgatagttgggtttggggtttcatgagtgcagggagacggccaggattacttgtggggagacaacattggagataaagtagtgcactggtaccagcagaagccaggccaggcccctcctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagccccaaggccaaccccactgtcactctgttcccacccncctcctacagtgct

SEQ ID NO: 535057 - DNA, 485 bp, Homo sapiens
  misc_feature: HIJSMM301BMFJF.22.59.F04.1.454.light.4.raw
acatacgcgtcacgaccggtgctcgatttagtacacacacttagggattggggaggaactgctcagttaggacccagacggaaccatggaagccccacgcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggtccagggaccaagctggagatcaacgaactgtgg

SEQ ID NO: 535058 - DNA, 506 bp, Homo sapiens
  misc_feature: HIJSMM301CVGTM.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccgcc

SEQ ID NO: 535059 - DNA, 501 bp, Homo sapiens
  misc_feature: HIJSMM301AEPNQ.4.27.C05.1.454.light.4.raw
agcactgtagcacgaccggtgctcgatttagacgcgatcgaagggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggccctccggggtcccgtgacaggttcagtggcagtggatcaggcacagattttactactgagaatcagcagagtggaggctgaggatgttggggtttacgtactgcatgcaagctctacaagccacctacacttttggtccaggggaccgaggcgtggaggatcaaacgaaactgtggtcg

SEQ ID NO: 535060 - DNA, 465 bp, Homo sapiens
  misc_feature: HIJSMM301BI9DB.3.20.B09.1.454.light.4.raw
agacgcactccacgaccggtgctcgatttagtgtagtgtgaaggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccaaggtggagatcaaacgaa

SEQ ID NO: 535061 - DNA, 481 bp, Homo sapiens
  misc_feature: HIJSMM301D6BYN.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactgtggctgcaccatctgt

SEQ ID NO: 535062 - DNA, 463 bp, Homo sapiens
  misc_feature: HIJSMM301DZQXZ.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccagagtggacatgaaacgaa

SEQ ID NO: 535063 - DNA, 452 bp, Homo sapiens
  misc_feature: HIJSMM301EWOTU.49.41.D08.1.454.light.4.raw
agtcgagagacacgaccggtgctcgatttagtcacgcgagaaagggaaaggggatcaggactcctcagttcacctcctcacaatgaggctccctgctcagctcctggggctgctaatgctctgggtctctggatccagtgggggtattgtgatgactcagtctccactctccctgcccgtcacccctggagagtcggcctccatctcctgcaggtctagtcagagcctcctatatagggatggatacaactatttggattggttcagcggcagtgtgtccggcacagatttttacactaaaaatcagcagagtggaggctgacgatattggggtttattactgcatgcaagcaatacaccgcctcactttcggtggagggaccacactggagatcaaacgaactgtggctgcaccatctgtcttcatcttcccgccatctgatctctcgact

SEQ ID NO: 535064 - DNA, 490 bp, Homo sapiens
  misc_feature: HIJSMM301CLDSM.10.72.G06.1.454.light.4.raw
catagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaac

SEQ ID NO: 535065 - DNA, 447 bp, Homo sapiens; identical to SEQ ID NO: 535020
  misc_feature: HIJSMM301BLN6P.18.9.A09.1.454.light.4.raw

SEQ ID NO: 535066 - DNA, 512 bp, Homo sapiens
  misc_feature: HIJSMM301B82WM.51.27.C05.1.454.light.4.raw
  modified_base (507)..(507): a, c, t, g, unknown or other
cgatcgtatacacgaccggtgctcgatttagacgcgatcgaagggtttggggctgggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctccggtnacctc

SEQ ID NO: 535067 - DNA, 494 bp, Homo sapiens
  misc_feature: HIJSMM301AOJ9H.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgagggtggagatcaggacgaactgtggctg

SEQ ID NO: 535068 - DNA, 486 bp, Homo sapiens
  misc_feature: HIJSMM301COFJQ.21.4.A04.1.454.light.4.raw
tcgtcgctcgcacgaccggtgctcgatttagagtagtgatcaggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaagggaccaaggtataatgaaacgaactgtggctgcaccat

SEQ ID NO: 535069 - DNA, 487 bp, Homo sapiens
  misc_feature: HIJSMM301A9UK7.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccagggaccaaggtggaagtcaagcgaactgtggctgcaccatctgt

SEQ ID NO: 535070 - DNA, 511 bp, Homo sapiens
  misc_feature: HIJSMM301A03LF.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgaaggaccgaaggtaggaagtacaaacgaactagtggctgcaccatctcgtcttctatcttcccgtcccact

SEQ ID NO: 535071 - DNA, 486 bp, Homo sapiens
  misc_feature: HIJSMM301A17Z6.13.87.H10.1.454.light.4.raw
tcacgtactacacgaccggtgctcgatttagcagtactgcgttgggtttgggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgt

SEQ ID NO: 535072 - DNA, 508 bp, Homo sapiens
  misc_feature: HIJSMM301AO2DR.8.28.C06.1.454.light.4.raw
ctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggtcggagggaccgaaggtggaccgtcaaacgaactgtggctgcaccatctgtcttcatccttcccgcc

SEQ ID NO: 535073 - DNA, 503 bp, Homo sapiens
  misc_feature: HIJSMM301BGCJL.13.81.H04.1.454.light.4.raw
tcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaacccactgtcactctcg

SEQ ID NO: 535074 - DNA, 441 bp, Homo sapiens
  misc_feature: HIJSMM301CK3H2.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccgccctcctcgtatctctcg

SEQ ID NO: 535075 - DNA, 493 bp, Homo sapiens
  misc_feature: HIJSMM301BGRZM.19.57.F02.1.454.light.4.raw
tactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctagctcctgatctatggtgcatccactttggtaaagtgggtccccgtccaaggttcagcggcagtggatctgggacagatttctactctcgccatcagcagcctgcagactgaagattttgcaacttattttgttcaacaggctaacacttcccctccacttcgtcggaggacgaacgtaggagatcaagacgaactagtggcgtgcaccatctgtctt

SEQ ID NO: 535076 - DNA, 489 bp, Homo sapiens
  misc_feature: HIJSMM301C0D31.40.37.D04.1.454.light.4.raw
tctagcgactcacgaccggtgctcgatttagtagcatactgttgggtttggggaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggccctcgggaccgacgagtggagtgtcaacgaaactgtgg

SEQ ID NO: 535077 - DNA, 504 bp, Homo sapiens
  misc_feature: HIJSMM301EHXVS.8.28.C06.1.454.light.4.raw
ctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcc

SEQ ID NO: 535078 - DNA, 483 bp, Homo sapiens
  misc_feature: HIJSMM301C3WZQ.17.34.D01.1.454.light.4.raw
cgtagactagcacgaccggtgctcgatttagatcgtctgtgttgggtttgggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcgccaaggaccaaggtggaactcaacgaa

SEQ ID NO: 535079 - DNA, 491 bp, Homo sapiens
  misc_feature: HIJSMM301ESA0W.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctggtcactctgttcccacct

SEQ ID NO: 535080 - DNA, 487 bp, Homo sapiens; identical to SEQ ID NO: 535069
  misc_feature: HIJSMM301C1L3V.26.23.C01.1.454.light.4.raw

SEQ ID NO: 535081 - DNA, 488 bp, Homo sapiens
  misc_feature: HIJSMM301DQ8U1.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtggctgcaccatctgt

SEQ ID NO: 535082 - DNA, 486 bp, Homo sapiens
  misc_feature: HIJSMM301A5T08.3.55.E11.1.454.light.4.raw
agacgcactccacgaccggtgctcgatttagcactcgcacgttgggtttggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactgtggctgcaccatctgt

SEQ ID NO: 535083 - DNA, 500 bp, Homo sapiens
  misc_feature: HIJSMM301BS82H.49.69.G03.1.454.light.4.raw
agtcgagagacacgaccggtgctcgatttagtcgctgcgtaaaggagaaaggggaggaactgctcagttaggacccagagggaaccatggaagccccagctcagcttctcttcctcctgcttctctggctcccagatattaccggagaaattgtgttgacgcagtctccagccaccctgtctttgtctccaggggaaagagccaccctctcctgcagggccagtcagagtgttaacatctacttagtctggtaccaacagaaagctggccacgctcccaggctcctcatctatgatacatccaccagggcccctggcatcccagccaggttcagtggcagtgggtctgggacagacttcactctcaccatcagcagcttagagcctgaagattttgcagtttattactgtcagcagcgtatcaccgggatcaccttcggccaagggacccgactggagattaagcgaactgtggctgcaccatctgtcttcatcttcccg

SEQ ID NO: 535084 - DNA, 493 bp, Homo sapiens
  misc_feature: HIJSMM301AT70S.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgtcttcatt

SEQ ID NO: 535085 - DNA, 494 bp, Homo sapiens; identical to SEQ ID NO: 534992
  misc_feature: HIJSMM301B4IDC.9.1.A01.1.454.light.4.raw

SEQ ID NO: 535086 - DNA, 446 bp, Homo sapiens
  misc_feature: HIJSMM301DTFAL.8.73.G07.1.454.light.4.raw
  modified_base (445)..(445): a, c, t, g, unknown or other
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcctccgccctcctcgacacgcgng

SEQ ID NO: 535087 - DNA, 524 bp, Homo sapiens
  misc_feature: HIJSMM301ANCXQ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctacttacgttcggcgggacggaacgaagggacggagtactacgaacgaaccgtaacgttggtcggtcgtcgacccaacctacttcgttcgttcctta

SEQ ID NO: 535088 - DNA, 382 bp, Homo sapiens; identical to SEQ ID NO: 534990
  misc_feature: HIJSMM301A312W.41.26.C04.1.454.light.4.raw

SEQ ID NO: 535089 - DNA, 515 bp, Homo sapiens
  misc_feature: HIJSMM301A10C7.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggccaacgggaccgaaggtaggaaggtcaaacgaactagtggcgtgcaccaatctgtcttctatcttcccgtcccact

SEQ ID NO: 535090 - DNA, 494 bp, Homo sapiens
  misc_feature: HIJSMM301DU084.27.78.H01.1.454.light.4.raw
  modified_base (403)..(403): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattacngtcatcagagtactactttacctcaagtgatcaccttcggccaagggacacgactggagattaaacgaactgtggctgcaccatctgtctt

SEQ ID NO: 535091 - DNA, 489 bp, Homo sapiens
  misc_feature: HIJSMM301AYDJ8.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacagggtaacagtttcccgctcaccttcggcggagggaccaaggtggagatgaaaagaactgtggctgcaccat

SEQ ID NO: 535092 - DNA, 490 bp, Homo sapiens
  misc_feature: HIJSMM301BP9WH.48.71.G05.1.454.light.4.raw
agtatacatacacgaccggtgctcgatttagtgtcgtcgcaagagagaggggaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaacctggccagcctcccaggctcctcatctatggtgcgtccaccagggccactggcatcccagacaggttcagtggcagtgggtctgggacagacttcactctcaccatcaccagactggagcctgatgatttgcagtgttttctgtcagcagtatggaagttcacctcggacattcggccaggggaccaaggtggaaatcaaacgaactgtggctgcaccatctgtcttcatcttcccgccatctgatatgtatact

SEQ ID NO: 535093 - DNA, 433 bp, Homo sapiens
  misc_feature: HIJSMM301A8T44.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggccagggaccaagctggagatcaaacgaactgtggctgcaccatctgtcttcatcttcccgccatctgacatactcgta

SEQ ID NO: 535094 - DNA, 421 bp, Homo sapiens
  misc_feature: HIJSMM301EK8WN.9.34.D01.1.454.light.4.raw
tgatacgtctcacgaccggtgctcgatttagatcgtctgtgttgggtttggggctgttcctggaagttgttggtaccagtgtcaccatctcgtgcactggaagtagctccaacatcggggcacgttatgatgtacactggtaccaacaacttccaggaacagcccccaaagtacatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccgaccctcctcagacgtatca

SEQ ID NO: 535095 - DNA, 511 bp, Homo sapiens
  misc_feature: HIJSMM301A8FYE.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccacggacgaacggtaggaagtacaagacgaacgtagtggcgtggcaccactctgtcttctactcttcccgt

SEQ ID NO: 535096 - DNA, 496 bp, Homo sapiens
  misc_feature: HIJSMM301CI3OR.40.17.B06.1.454.light.4.raw
tctagcgactcacgaccggtgctcgatttagtcgatagtgaaggggaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatctataaggcgtctagtttagaaagtggggtcccatcaaggatcagcggcagtggatctgggacagaattcactctcaccattagtagcctgcagcctgatgattttgcaacttattactgccaacaatataatgattttccgtggacgttcggccaagggaccaaggtagaaatcaaacgaactgtggctgcaccatctgtcttcatcttcccg

SEQ ID NO: 535097 - DNA, 479 bp, Homo sapiens
  misc_feature: HIJSMM301CQCOM.17.67.G01.1.454.light.4.raw
cgtagactagcacgaccggtgctcgatttagagtatacatattgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcacagcattagcagctatttaaattggtatcagcagaaaccagggagagcccctaacctcctgatctatgctgcatccagtttgcagagtggggtcccatcaaggttcagtggcagtggatctgggacagatttcactctcaccatcagcagtctgcaacctgaagattttgcaacttactactgtcaacagagtctcagtacccccgcgtcgtcggacggacgacggaggtaagaacaacgaaactacgtggt

SEQ ID NO: 535098 - DNA, 476 bp, Homo sapiens
  misc_feature: HIJSMM301BL3GW.5.28.C06.1.454.light.4.raw
atcagacacgcacgaccggtgctcgatttagagctcacgtattgggtttggggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccaaggtggagatcgaacgaactgtggctgca

SEQ ID NO: 535099 - DNA, 490 bp, Homo sapiens
  misc_feature: HIJSMM301BLQIN.49.66.F11.1.454.light.4.raw
agtcgagagacacgaccggtgctcgatttagtcacgcgagaaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttggacagacttcacgctcaccatcagcagcctagagcctgaagattttgcagtttatactgtcaacagcgtaccacaggattcactttcggccctgggaccagagtggatatcaacgaactgtggctgcaccatctgtcttcatcttcccg

SEQ ID NO: 535100 - DNA, 453 bp, Homo sapiens
  misc_feature: HIJSMM301CCG2I.19.71.G05.1.454.light.4.raw
tactctcgtgcacgaccggtgctcgatttagtgtcgtcgcaagagagaggggcacttctccctctaacactctcccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgcaccatctgtcttcatcttcccgccatctgacacgagagta

SEQ ID NO: 535101 - DNA, 444 bp, Homo sapiens
  misc_feature: HIJSMM301C5NI8.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtcccgtgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctcgccccctccggtcactctgttcccaccctcctcgtatctctcg

SEQ ID NO: 535102 - DNA, 465 bp, Homo sapiens
  misc_feature: HIJSMM301CX2PQ.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgcccccgctcagtttcggcggagggaccaaggtggagata

SEQ ID NO: 535103 - DNA, 496 bp, Homo sapiens
  misc_feature: HIJSMM301BWRBK.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcgtcactctcg

SEQ ID NO: 535104 - DNA, 500 bp, Homo sapiens
  misc_feature: HIJSMM301BUZ0A.48.29.C07.1.454.light.4.raw
agtatacatacacgaccggtgctcgatttagagtgctacgaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggacctcgtccacggacgacgactgagataaagtaactagtggctgcaccactctgtcttcatcttccgtcccta

SEQ ID NO: 535105 - DNA, 501 bp, Homo sapiens
  misc_feature: HIJSMM301EXAG2.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggacggtccggggtcccgtgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccatctgaca

SEQ ID NO: 535106 - DNA, 492 bp, Homo sapiens
  misc_feature: HIJSMM301CSVRK.10.79.H02.1.454.light.4.raw
catagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagatttgcagtgtattattgtcagcaatatggtaggtcacctgggacttttggccaggggaccaagctggagatcaaacgaactgtggctgcaccatctgtctt

SEQ ID NO: 535107 - DNA, 512 bp, Homo sapiens
  misc_feature: HIJSMM301CXKD4.15.76.G10.1.454.light.4.raw
  modified_base (487)..(487): a, c, t, g, unknown or other
tctacgtagccacgaccggtgctcgatttagtcactcatacagggggcgccagggtcccgttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtnactctgttcccaccctcctcgcacg

SEQ ID NO: 535108 - DNA, 507 bp, Homo sapiens
  misc_feature: HIJSMM301ATVKH.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaagggaccaaggtaggaagtacaaacgaactagtggcgtgcgaccatctgtcttctatcttccccg

SEQ ID NO: 535109 - DNA, 496 bp, Homo sapiens
  misc_feature: HIJSMM301ATMZK.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgt

SEQ ID NO: 535110 - DNA, 476 bp, Homo sapiens
  misc_feature: HIJSMM301ARIYQ.49.4.A04.1.454.light.4.raw
agtcgagagacacgaccggtgctcgatttagagtagtgatcgaggggcaggagtcagtcccaaccgaggacgacaaggcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcggggggaccgaagtggagatcaagcgaactgtgg

SEQ ID NO: 535111 - DNA, 443 bp, Homo sapiens
  misc_feature: HIJSMM301C30SX.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccgacccctcctcgtatctctcg

SEQ ID NO: 535112 - DNA, 494 bp, Homo sapiens
  misc_feature: HIJSMM301AD0LP.43.29.C07.1.454.light.4.raw
tgtgagtagtcacgaccggtgctcgatttagagtgctacgaagggaaaggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcggcggtagtggatctgggacagaattcactctcaccgtcagcagcctgcagcctgaagattttgcaacttattactgtcaacagtttaataactaccctctcactttcggaggagggaccagggtggaggatcaaacgaaactgtggctgcaccatctgtcttcat

SEQ ID NO: 535113 - DNA, 493 bp, Homo sapiens
  misc_feature: HIJSMM301AKQLX.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacggggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttcccg

SEQ ID NO: 535114 - DNA, 452 bp, Homo sapiens
  misc_feature: HIJSMM301AXID1.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgcccctcggtcactctgttcccgccctcctccacgagagta

SEQ ID NO: 535115 - DNA, 501 bp, Homo sapiens
  misc_feature: HIJSMM301B4BEY.48.71.G05.1.454.light.4.raw
agtatacatacacgaccggtgctcgatttagtgtcgtcgcaagagagaggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaacctgaccagcctcccaggctcctcatctatggtgcgtccaccagggccactggcatcccagacaggttcagtggcagtgggtctgggacagacttcactctcaccatcaccagactggagcctgatgattttgcagtgttttctgtcagcagtatggaagttcacctcggacattcggccaggggaccaaggtggaaatcaaacgaactgtggctgcaccatctgtcttcatcttcccg

SEQ ID NO: 535116 - DNA, 477 bp, Homo sapiens
  misc_feature: HIJSMM301CJMS7.51.53.E09.1.454.light.4.raw
cgatcgtatacacgaccggtgctcgatttagagagagtgtgttgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcggggcggaacagctcgccgtcgtcgacaccgaccga

SEQ ID NO: 535117 - DNA, 509 bp, Homo sapiens
  misc_feature: HIJSMM301AKG43.12.73.G07.1.454.light.4.raw
atacgacgtacacgaccggtgctcgatttagctctacgctcaggggctgggcccaaggaagcagcactggtggtgcctcagccatggcctggaccgttctcctcctcggcctcctctctcactgcacagcctctgtgacctcctatgtactgattcagtcgccctcggtgtcagtggccccaggacagacggccacgattacctgtggaggagacaatattgtcaccaaaagtgttcactggtaccagcagaagccaggccaggcccctgtggtggtcgtctatgatgatagcgaccggccctcggggatccctgagcgattctctggctccaactctgggaacatggccaccctgaccatccgcagggtcgaggccggggatgaggccgactattattgtcaggtgtgggataatggcagtgatcatgtcttattcggcggagggaccacgctgaccgtcctaagtcagccccaaggctgccccctccggtcactctgttcccaccct

SEQ ID NO: 535118 - DNA, 479 bp, Homo sapiens
  misc_feature: HIJSMM301APEUO.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtgg

SEQ ID NO: 535119 - DNA, 490 bp, Homo sapiens
  misc_feature: HIJSMM301DM3KA.51.71.G05.1.454.light.4.raw
cgatcgtatacacgaccggtgctcgatttagtgtcgtcgcaagagagagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccca

SEQ ID NO: 535120 - DNA, 506 bp, Homo sapiens
  misc_feature: HIJSMM301DFDSE.43.4.A04.1.454.light.4.raw
tgtgagtagtcacgaccggtgctcgatttagagtagtgatcagggtcattaatgtcagcggcacagcaaccgcgggcactttcggcggagggaccaaggtggagatcaagcgtgagtgcactttcctagtgctttttcttataaggcctgaaatttggagtctttttgtgtttgagacattacctcaggtccattccagagagttccagaggtccattccagagagttccagaggctttcaaaaaggtccgatgagtaagggatcgaaagttagtccatcttaaggagcagccaagcgctggtcagttaagagcggcgcctcatttgcaagattttctctgcgtcggccaggttagtgatcttcacgacgaaaagacatttttcttgagggaaaagtaattaagttaatgttgtggatcagcttcggccaagggacgcgactggagattaaacgaactgtggctgcaccatctgtcttcatcttcccgccatctgaactactcaca

SEQ ID NO: 535121 - DNA, 512 bp, Homo sapiens
  misc_feature: HIJSMM301DMBR0.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccaagggaccgaacggtaggaagtacaaacgaactagtggcgtgcaccatctgtcttctatcttcccgtccact

SEQ ID NO: 535122 - DNA, 477 bp, Homo sapiens
  misc_feature: HIJSMM301A4I7Z.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgaactgtggctgcaccatctgtcttcatcttcccgccatctgaagtatagtct

SEQ ID NO: 535123 - DNA, 485 bp, Homo sapiens
  misc_feature: HIJSMM301C2P7C.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtgggtcccatcaaggttcagcggcagtggatctgggacagaattcactctcacaatcagcagcctgcagcctgaagattttgcaacttattactgtcaacagcttaatagttacccgctcagtttcggcgagggaccaaggtggagatcaaacgaactgtggctgcaccatctgt

SEQ ID NO: 535124 - DNA, 507 bp, Homo sapiens
  misc_feature: HIJSMM301BW2QF.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcgagagggtcaccatctcttgttctggaggcaactccaacatcggaagtaattatgtattctggtatcagcaactcccaggaatggcccccaaactcctcatccagaggaataatcagcggccctcaggggtcccctgaccgattctctggctccaagtctggcacctcagcctccctgaccatcagtgggctccggtccgaggatgaggctgactattactgtgcatcacggggacgcaacatggggatgacaatctgagcggttgggtgttcggacggagggaccaaactgaccgtcctaggtcagcccaac

SEQ ID NO: 535125 - DNA, 488 bp, Homo sapiens
  misc_feature: HIJSMM301EJPOC.17.25.C03.1.454.light.4.raw
cgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatctgt

SEQ ID NO: 535126 - DNA, 492 bp, Homo sapiens
  misc_feature: HIJSMM301B2H9U.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccat

SEQ ID NO: 535127 - DNA, 524 bp, Homo sapiens
  misc_feature: HIJSMM301BN58T.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcgagtggagtcaggcgacagattttacgtctgaaaataacagtagggtggaggcgtgaggaagtgttggggtttaggttacttgcatgcaagttacttacaaacttaccttaccaacttttggttccgacgggaccggaacgactggaggatacaacgaaactagtggcgtgca

SEQ ID NO: 535128 - DNA, 504 bp, Homo sapiens
  misc_feature: HIJSMM301DFWFU.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtca

SEQ ID NO: 535129 - DNA, 478 bp, Homo sapiens
  misc_feature: HIJSMM301B8WA8.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgtctt

SEQ ID NO: 535130 - DNA, 504 bp, Homo sapiens
  misc_feature: HIJSMM301CGJRR.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggagtcaagcgaactgtggctgcaccatctgtcttcatcttccgcc

SEQ ID NO: 535131 - DNA, 494 bp, Homo sapiens
  misc_feature: HIJSMM301BF56S.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtatttgcagtgtattactgtcagcagtatcataggtcaaacaccttcggccaaggacacgactggagattaaaggaactgtggctgcaccatctgtcttctatcttccccg

SEQ ID NO: 535132 - DNA, 494 bp, Homo sapiens
  misc_feature: HIJSMM301C7E84.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggacgaacgcggagatcagacgaactgtggcgtcgcaccaactctcgtcttact

SEQ ID NO: 535133 - DNA, 494 bp, Homo sapiens; identical to SEQ ID NO: 534992
  misc_feature: HIJSMM301BGK4Z.9.1.A01.1.454.light.4.raw

SEQ ID NO: 535134 - DNA, 493 bp, Homo sapiens
  misc_feature: HIJSMM301A0KA4.15.59.F04.1.454.light.4.raw
tctacgtagccacgaccggtgctcgatttagtacacacacttagggattggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcactctgttcccaccctcctcgctacgtaga

SEQ ID NO: 535135 - DNA, 499 bp, Homo sapiens
  misc_feature: HIJSMM301ERLQ9.10.65.F10.1.454.light.4.raw
  modified_base (469)..(469): a, c, t, g, unknown or other
catagtagtgcacgaccggtgctcgatttagctacgctctaaggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttcccggaaccccgttactttcggcggagggacaacggtggagatcaaacgaactntggctgcaccatctgtcttcatcttccccg

SEQ ID NO: 535136 - DNA, 506 bp, Homo sapiens
  misc_feature: HIJSMM301CSKN1.11.75.G09.1.454.light.4.raw
  modified_base (494)..(494): a, c, t, g, unknown or other
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtnactctgttccca

SEQ ID NO: 535137 - DNA, 381 bp, Homo sapiens
  misc_feature: HIJSMM301BDOIT.41.26.C04.1.454.light.4.raw
tctatactatcacgaccggtgctcgatttagtctagcgactttgggtttggggaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 535138 - DNA, 509 bp, Homo sapiens
  misc_feature: HIJSMM301AYQID.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctgtttccg

SEQ ID NO: 535139 - DNA, 489 bp, Homo sapiens
  misc_feature: HIJSMM301BV5LO.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 535140 - DNA, 503 bp, Homo sapiens
  misc_feature: HIJSMM301BPB90.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcaccatct

SEQ ID NO: 535141 - DNA, 488 bp, Homo sapiens
  misc_feature: HIJSMM301BOYC6.41.17.B06.1.454.light.4.raw
tctatactatcacgaccggtgctcgatttagtcgatagtgaagggggaactgctcagttaggacccacgacggaaccatggaagccccacgcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcta

SEQ ID NO: 535142 - DNA, 487 bp, Homo sapiens
  misc_feature: HIJSMM301CL9BQ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcggccaccagtcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 535143 - DNA, 495 bp, Homo sapiens
  misc_feature: HIJSMM301A2OPE.51.29.C07.1.454.light.4.raw
cgatcgtatacacgaccggtgctcgatttagagtgctacgaagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccaaggtggaaatgaaaggaactgtggctgcaccatctgtctt

SEQ ID NO: 535144 - DNA, 483 bp, Homo sapiens
  misc_feature: HIJSMM301DGCGS.12.23.C01.1.454.light.4.raw
  modified_base (458)..(458): a, c, t, g, unknown or other
atacgacgtacacgaccggtgctcgatttagtacacgtgattagggattggggaggaactgctcagttaggacccagacggaaccatggaagccccagcgcagcttctcttcctcctgctactctggctcccagataccactggagaaatagtgatgaagcagtctccagccacctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttatactgtcagcagtataataactggttcctgctcactttcggcgggggaccgagtggngatcaacgaactgtggcgtgcacca

SEQ ID NO: 535145 - DNA, 503 bp, Homo sapiens
  misc_feature: HIJSMM301BI3WI.8.19.B08.1.454.light.4.raw
ctcgcgtgtccacgaccggtgctcgatttagtgagtcagtaaggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattagagatcaaacgaactgtggctgcaccatctgtcttcatcttcccgcc

SEQ ID NO: 535146 - DNA, 479 bp, Homo sapiens
  misc_feature: HIJSMM301EQZ9M.21.25.C03.1.454.light.4.raw
tcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttgctgttcggcggcgggacc

SEQ ID NO: 535147 - DNA, 492 bp, Homo sapiens
  misc_feature: HIJSMM301A85IC.40.12.B01.1.454.light.4.raw
tctagcgactcacgaccggtgctcgatttagtagtgtagattccgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgcacc

SEQ ID NO: 535148 - DNA, 501 bp, Homo sapiens
  misc_feature: HIJSMM301A0SSI.15.57.F02.1.454.light.4.raw
tctacgtagccacgaccggtgctcgatttagctcgatatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccaccctcctcgctacgtaga

SEQ ID NO: 535149 - DNA, 493 bp, Homo sapiens
  misc_feature: HIJSMM301A4PGD.14.55.E11.1.454.light.4.raw
  modified_base (425)..(425): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccncacttcgtcggaggacgaacgaggacgatcagacgaacgtagtggcgtgcaccaactctcgtcttcta

SEQ ID NO: 535150 - DNA, 491 bp, Homo sapiens
  misc_feature: HIJSMM301AOT7Z.49.28.C06.1.454.light.4.raw
agtcgagagacacgaccggtgctcgatttagagctcacgtattgggtttggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 535151 - DNA, 414 bp, Homo sapiens
  misc_feature: HIJSMM301DHLCA.16.46.E02.1.454.light.4.raw
tgtactactccacgaccggtgctcgatttagactcatctacagggaaaggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccacctcctcgagtagtaca

SEQ ID NO: 535152 - DNA, 494 bp, Homo sapiens; identical to SEQ ID NO: 534992
  misc_feature: HIJSMM301AEPNZ.9.1.A01.1.454.light.4.raw

SEQ ID NO: 535153 - DNA, 434 bp, Homo sapiens
  misc_feature: HIJSMM301AV8I7.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggccaggggaccaagctggagatcaaacgaactgtggctgcaccatctgtcttcatcttcccgccatctgacatactcgta

SEQ ID NO: 535154 - DNA, 493 bp, Homo sapiens
  misc_feature: HIJSMM301A4VHD.3.36.D03.1.454.light.4.raw
agacgcactccacgaccggtgctcgatttagctgcgtcacgatctctcttggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgcagtttattactgtcagcagtatggtacttcacaaaccttcggccaggggacacgactggagattaagcgaactgtggctgcaccatctgtctt

SEQ ID NO: 535155 - DNA, 475 bp, Homo sapiens
  misc_feature: HIJSMM301A6DZW.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaaactgtggctgcaccatctgtcttcatcttcccgccatctgagacacgcgagt

SEQ ID NO: 535156 - DNA, 486 bp, Homo sapiens
  misc_feature: HIJSMM301BKHW9.46.38.D05.1.454.light.4.raw
actagcagtacacgaccggtgctcgatttagtatctgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 535157 - DNA, 447 bp, Homo sapiens; identical to SEQ ID NO: 535020
  misc_feature: HIJSMM301BXHE6.18.9.A09.1.454.light.4.raw

SEQ ID NO: 535158 - DNA, 498 bp, Homo sapiens
  misc_feature: HIJSMM301CVCUR.41.45.E01.1.454.light.4.raw
tctatactatcacgaccggtgctcgatttagtgagtcagtaagggaaaggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcactc

SEQ ID NO: 535159 - DNA, 444 bp, Homo sapiens
  misc_feature: HIJSMM301BYN0A.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcagggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctccggtcactctgttcccgccctcctcgacacgcgag

SEQ ID NO: 535160 - DNA, 477 bp, Homo sapiens
  misc_feature: HIJSMM301C7N7W.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgctt

SEQ ID NO: 535161 - DNA, 485 bp, Homo sapiens; identical to SEQ ID NO: 535018
  misc_feature: HIJSMM301BC6IN.46.35.D02.1.454.light.4.raw

SEQ ID NO: 535162 - DNA, 485 bp, Homo sapiens
  misc_feature: HIJSMM301EOG6G.5.70.G04.1.454.light.4.raw
atcagacacgcacgaccggtgctcgatttagtgtagtgtgaagggaaagggggaggtcagacccacgtcaggacacagcatggacatgagggtccccggcctcagctcctggggcgtcctgctgctctggttcccacggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggcggagggaccaaggtggagatcaaacgaactgtggctgca

SEQ ID NO: 535163 - DNA, 447 bp, Homo sapiens; identical to SEQ ID NO: 535020
  misc_feature: HIJSMM301C1FST.18.9.A09.1.454.light.4.raw

SEQ ID NO: 535164 - DNA, 381 bp, Homo sapiens
  misc_feature: HIJSMM301CS0I0.41.33.C11.1.454.light.4.raw
tctatactatcacgaccggtgctcgatttagagtgagctcgttgggtttggggaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 535165 - DNA, 489 bp, Homo sapiens
  misc_feature: HIJSMM301BR4JL.17.26.C04.1.454.light.4.raw
cgtagactagcacgaccggtgctcgatttagtctagcgactttgggtttggggaggtcagtctcagtcaggacacagcatggacatgagggtccccgcctcagctcctggggctcctgctactctggctccgaggtgccagatgtgacatcccagatgacccagtcgtccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcacca

SEQ ID NO: 535166 - DNA, 491 bp, Homo sapiens
  misc_feature: HIJSMM301C5JOH.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttgggttgttcctccatgcaaggtacacactggccttttggccaggggaccaacctggagatcaaatgaactgtggctgcaccatctgtctt

SEQ ID NO: 535167 - DNA, 499 bp, Homo sapiens
  misc_feature: HIJSMM301CCQKU.19.57.F02.1.454.light.4.raw
tactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtccccgtccaaggttcagcggcagtggatctgggacagatttcactctcgccatcagcagcctgcagactgaagattttgcaacttattttgtcaacaggctaacactttccccctccactttcggtcggagggacgaacggtaggtaggatcaagacgaactgtggctgcaccatctgtcttt

SEQ ID NO: 535168 - DNA, 504 bp, Homo sapiens
  misc_feature: HIJSMM301D0863.48.70.G04.1.454.light.4.raw
agtatacatacacgaccggtgctcgatttagtgtagtgtgaagggaaaggggagctacaacaggcaggcaggggcgagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccgaacctggaatcaaacgaactgtggctgcaccatctgt

SEQ ID NO: 535169 - DNA, 488 bp, Homo sapiens
  misc_feature: HIJSMM301AJ4BT.16.72.G06.1.454.light.4.raw
tgtactactccacgaccggtgctcgatttagctacgactgcaagggaaaggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtggagatcaaacgaactgtggctgcaccat

SEQ ID NO: 535170 - DNA, 495 bp, Homo sapiens
  misc_feature: HIJSMM301ANGK6.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggtccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccagggacccaggtggagatcagacgaactgtggctgcaccatctgtcttcatcttcccg

SEQ ID NO: 535171 - DNA, 476 bp, Homo sapiens
  misc_feature: HIJSMM301B3UUC.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaagtaatgaagttaacactgtggatcaccttcggccaagggacacgactggagattaaacgaactgtggctgcaccatctgtcttcatcttcccgccatctgaagtatagtct

SEQ ID NO: 535172 - DNA, 477 bp, Homo sapiens
  misc_feature: HIJSMM301DL8TO.52.53.E09.1.454.light.4.raw
cgcagtacgacacgaccggtgctcgatttagagagagtgtgttgggtttggggcagcctcagcagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcgagtgggcactacacctacgccatcgcatggcatcagctgcagccagagaagggccctcggtacttgatgaggctcaacagtgatggcagccacagcggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcct

SEQ ID NO: 535173 - DNA, 453 bp, Homo sapiens
  misc_feature: HIJSMM301CVDAT.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 535174 - DNA, 482 bp, Homo sapiens
  misc_feature: HIJSMM301EPAPL.47.48.E04.1.454.light.4.raw
agctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcgccaaggaccgaaggtggaaagtcaacgaaactgtggctgcacca

SEQ ID NO: 535175 - DNA, 496 bp, Homo sapiens
  misc_feature: HIJSMM301BITOH.41.54.E10.1.454.light.4.raw
tctatactatcacgaccggtgctcgatttagatcgtagcagaacacacaaaggggactgatcaggactcctcagttcaccttctcacaatgaggctccctgctcagctcctggggctgctaatgctctgggtcccaggatgcagtggggatgctattctgactcagtcgccgctctccctgcccgtctcccttggacagccggcctccatttcctgcacgtctagtcaaagtctcctacatgatgatggaaacacctacctgacttggtttcaccacaggccaggccaatctccaaggcgcctaatttatcaggtttcgaagcgggactctggggtcccaggcagattcagcggcagtgggtcaggctctgctttcacgctgagaatcaacagggtggaggctgaggatgttggtgtttattactgcatgcaaggttcatattggccgtgcagttttggccaggggaccaagttggagatcaaacgaactgtggcg

SEQ ID NO: 535176 - DNA, 491 bp, Homo sapiens
  misc_feature: HIJSMM301AZX86.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaa

SEQ ID NO: 535177 - DNA, 493 bp, Homo sapiens
  misc_feature: HIJSMM301ALV7Z.5.57.F02.1.454.light.4.raw
atcagacacgcacgaccggtgctcgatttagctcgatatagttgggtttgggggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcgccacggaccgacagtggatatcaggcgaactgtggctgcaccaatctgtcttcta

SEQ ID NO: 535178 - DNA, 505 bp, Homo sapiens
  misc_feature: HIJSMM301AJZQB.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccggcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttactgtcagcagtatagtaactaggcctccgtactactttggtccgacgggaccgaacgactacgaaatacaaaccgaaactagtggcgtgcaccatctgtcttcat

SEQ ID NO: 535179 - DNA, 494 bp, Homo sapiens
  misc_feature: HIJSMM301DLAIS.9.1.A01.1.454.light.4.raw
tgatacgtctcacgaccggtgctcgatttagacgtctcatcagggggagctgctcagttaggacccagagggaaccatggaaaccccacgcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgcttcatcttccccg

SEQ ID NO: 535180 - DNA, 489 bp, Homo sapiens
  misc_feature: HIJSMM301AR39L.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatctt

SEQ ID NO: 535181 - DNA, 493 bp, Homo sapiens
  misc_feature: HIJSMM301A5GGD.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggacgacgtaggagttcaaacgaactgtggctgcaccatctgtcttcat

SEQ ID NO: 535182 - DNA, 500 bp, Homo sapiens
  misc_feature: HIJSMM301A2GL9.22.25.C03.1.454.light.4.raw
acatacgcgtcacgaccggtgctcgatttagtagtgtagatttgggtttgggggcgaggagtcagacccacgtcaggacacagcatggacatgagggtccccggcctcagctcctggggcgtcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaactaggtgtcccatcaaggttcagcggcagtggatctgggacagaattcactctcgccatcagcagcctgcagcctgatgattctgcaacttattactgccaacagtattatagttatcgggggacgttcggccaagggaccgaaggtggaaatacaaacgaactgtggctgcaccatctgtt

SEQ ID NO: 535183 - DNA, 486 bp, Homo sapiens
  misc_feature: HIJSMM301EC0PX.12.33.C11.1.454.light.4.raw
atacgacgtacacgaccggtgctcgatttagagtgagctcgttgggtttggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgaagacagagttcactctcaccatcagcactctacagcctgaagattttgcaacttattattgtcaacaaagttatgagacccctgccactttcggccctgggaccatagtggatatgaaacgaactgtggctgcacc

SEQ ID NO: 535184 - DNA, 494 bp, Homo sapiens
  misc_feature: HIJSMM301C9898.16.71.G05.1.454.light.4.raw
tgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctcccaggctcctcatctatggtgcatccagcagggccactggcatcccagacaggttcagtggcagtgggtctgggacagacttcactctcaccctcagcagactggagcctgaagattttgcagtgtattactgtcagcagtatggtagggcaccttacacttttggccaggggaccaagctggagatcaaacgaactgtggctgcaccatctgtctt

SEQ ID NO: 535185 - DNA, 486 bp, Homo sapiens
  misc_feature: HIJSMM301A30HT.46.26.C04.1.454.light.4.raw
actagcagtacacgaccggtgctcgatttagtctagcgactttgggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcggggcctccggggtccctgacaggttcagtggcagtgggatcaggcacagattttactactgaaaatacagcagagtggaggctgaggatgttgggctctattattgcatgcaagctctacaagtccgcctcacttcggtcggaggaccgaagtggagatcaaacgaa

SEQ ID NO: 535186 - DNA, 500 bp, Homo sapiens
  misc_feature: HIJSMM301ASVFH.40.4.A04.1.454.light.4.raw
  modified_base (483)..(483): a, c, t, g, unknown or other
tctagcgactcacgaccggtgctcgatttagagtagtgatcaggggagctacaacaggcaggcaggggcagcaagatggtgttgcagacccaggtcttcatttctctgttcctctggatctctggtgccttcggggacatcgtgatgacccagtctccagactccctggctctgtctctgggcgagagggccaccatcaactgcaagtccagccagagcgttttatccacttcctacaatcagaattacttagcttggtatcagcataaaccagggcagcctccgaggctgctcatttactggacatctagtccgggaatccggggtccctgaccgattccgtggcagtgggtctgggacagattttactctcaccatcaccagccttcaggctgaagatgtggcagtttattactgtcaccaatatttagacattcctccgacgttcggccgaacggaccaaggtggagatcaaacgaactntggctgcaccatctgtt

SEQ ID NO: 535187 - DNA, 486 bp, Homo sapiens
  misc_feature: HIJSMM301CZT2Z.49.35.D02.1.454.light.4.raw
agtcgagagacacgaccggtgctcgatttagcacacgatagttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaaggctcg

SEQ ID NO: 535188 - DNA, 479 bp, Homo sapiens
  misc_feature: HIJSMM301A082R.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgcagtttattactgtcagcagtatactaactggcctctgacgttcggccaagggaccagggtggaaatcaaacgaactgtggctgcaccat

SEQ ID NO: 535189 - DNA, 491 bp, Homo sapiens
  misc_feature: HIJSMM301A1VTD.41.59.F04.1.454.light.4.raw
tctatactatcacgaccggtgctcgatttagtacacacacttagggattgggggcaggagtcagacccagtcaggacacagcatggacatgagggtccccgctcagctcctggggctcctgctgctctggttcccaggttcccgatgcggcatccagatgacccagtctccatctttcgtgtctgcatctataggagacagagtcaccatcacttgtcgggcgagtcaggatattaggacgtggttagcctggtatcgacagagaccgggaagagcccctgaactcctcgtctatgatgcatccactttacatcgtggggtcccatcacggttcagcggcagtggatctgggacagacttcagtctcaccatcagtaccctgcagcctgacgattttgcaatttattttgtcaacaggctaataggttccctcaaacattcggccctgggaccagagtggatttgaagcgaactgtggctgcaccatctgt

SEQ ID NO: 535190 - DNA, 500 bp, Homo sapiens
  misc_feature: HIJSMM301CRR2R.53.71.G05.1.454.light.4.raw
cgcgtatacacacgaccggtgctcgatttagtgtcgtcgcaagagagaggggcacgaccggtgctcgatttagtgtcgtcgcaagagagaggggctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcgggcggagggaccaag

SEQ ID NO: 535191 - DNA, 506 bp, Homo sapiens
  misc_feature: HIJSMM301C2L3H.14.7.A07.1.454.light.4.raw
cgtctagtaccacgaccggtgctcgatttagcacgtgtcgcagggggccctgaggaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccgtcctacgtcagccc

SEQ ID NO: 535192 - DNA, 444 bp, Homo sapiens
  misc_feature: HIJSMM301CNF8R.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccaccctcctccgtgtctgat

SEQ ID NO: 535193 - DNA, 486 bp, Homo sapiens; identical to SEQ ID NO: 535043
  misc_feature: HIJSMM301A9VDK.46.35.D02.1.454.light.4.raw

SEQ ID NO: 535194 - DNA, 491 bp, Homo sapiens
  misc_feature: HIJSMM301B0M5N.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtt

SEQ ID NO: 535195 - DNA, 390 bp, Homo sapiens
  misc_feature: HIJSMM301CHXSL.21.40.D07.1.454.light.4.raw
tcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtcccgtgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtcctaggtcagcccaaggctgccccctcggtcactctgttcccaccctcctccgagcgacga

SEQ ID NO: 535196 - DNA, 424 bp, Homo sapiens
  misc_feature: HIJSMM301CMRM0.41.14.B03.1.454.light.4.raw
tctatactatcacgaccggtgctcgatttagtgtgagtagttccggcgggcacgaccggtgctcgatttagtctagcgactttgggtttgggggaaagagccaccctctcctgcagggccagtgagacagttactgtcaattacttagcctggtaccagcagaagcctggccacggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 535197 - DNA, 493 bp, Homo sapiens
  misc_feature: HIJSMM301D2HSK.16.78.H01.1.454.light.4.raw
tgtactactccacgaccggtgctcgatttagtgtgagtagtttgggtttggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctcacggtacacttttggccagggaccaagctggagatcaaacgaactgtggctgcaccatctgt

SEQ ID NO: 535198 - DNA, 519 bp, Homo sapiens
  misc_feature: HIJSMM301DGTHL.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctcgttcccgccctcctccacg

SEQ ID NO: 535199 - DNA, 493 bp, Homo sapiens
  misc_feature: HIJSMM301CR43Y.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtggaccaagctgaccgtcctaggtcagcccaagg

SEQ ID NO: 535200 - DNA, 505 bp, Homo sapiens
  misc_feature: HIJSMM301DVJZL.11.75.G09.1.454.light.4.raw
  modified_base (472)..(472): a, c, t, g, unknown or other
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtcccgtgaccggttctctggctccaagtctggctcttccgcctccttggccatcactgggctcgaggctgacgatgaggctgattactactgtctgtcctatgacgacgacctacagactccggttttcggcggagggactaagctgaccgtcctagtcngcccaaggctgccccctcggtcactctgtcccg

SEQ ID NO: 535201 - DNA, 447 bp, Homo sapiens
  misc_feature: HIJSMM301BG8B7.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 535202 - DNA, 516 bp, Homo sapiens
  misc_feature: HIJSMM301CWOSQ.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgaacgggaccgaacggtaggaagtacgaaacgaactagtggcgtgcaccactctgtcttctactcttcccgcccact

SEQ ID NO: 535203 - DNA, 403 bp, Homo sapiens
  misc_feature: HIJSMM301EHUZ8.4.35.D02.1.454.light.4.raw
agcactgtagcacgaccggtgctcgatttagcacacgatagttgggtttggggtttcatgagtgcagggagacggccaggattacttgtgggggagacaacattggagataaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgtcactctgttcccgccctcctcctacagtgct

SEQ ID NO: 535204 - DNA, 489 bp, Homo sapiens
  misc_feature: HIJSMM301AGSKV.48.78.H01.1.454.light.4.raw
  modified_base (470)..(470): a, c, t, g, unknown or other
agtatacatacacgaccggtgctcgatttagtgtgagtagtttgggtttggggcgagctcaggaagcagagcctggagcatctccactatggcctgggctccactacttctcaccctcctcgctcactgcacaggttcttgggcccattttattgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggaggaccgaanctgaccgtcctaggtcacg

SEQ ID NO: 535205 - DNA, 447 bp, Homo sapiens; identical to SEQ ID NO: 535020
  misc_feature: HIJSMM301DBSBF.18.9.A09.1.454.light.4.raw

SEQ ID NO: 535206 - DNA, 454 bp, Homo sapiens
  misc_feature: HIJSMM301CEFBS.19.86.H09.1.454.light.4.raw
tactctcgtgcacgaccggtgctcgatttagtgctatagacttgggtttggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctccggtcactctgttcccaccctcctccaccgagagta

SEQ ID NO: 535207 - DNA, 454 bp, Homo sapiens; identical to SEQ ID NO: 534964
  misc_feature: HIJSMM301A3WYZ.19.86.H09.1.454.light.4.raw

SEQ ID NO: 535208 - DNA, 473 bp, Homo sapiens
  misc_feature: HIJSMM301CSGS1.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgcttttcttataaggtttaagtttggagcgttttgtgtttgagatgttagctcaggtcaattccaaagagtaccagattctttcaaaagtcagatgagtaagggatagaaattagttcaccttaaggaacagccaagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgaactgtggctgcaccatctgtcttcatcttcccgccatctgaagtatagtct

SEQ ID NO: 535209 - DNA, 515 bp, Homo sapiens
  misc_feature: HIJSMM301D64TI.49.26.C04.1.454.light.4.raw
agtcgagagacacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttcccgccctcct

SEQ ID NO: 535210 - DNA, 314 bp, Homo sapiens
  misc_feature: HIJSMM301C111R.48.78.H01.1.454.light.4.raw
agtatacatacacgaccggtgctcgatttagtgtgagtagtttgggtttgggggagctacaacaggcaggcaggggcagcaagatggtgttgcagacccaggtcttcatttctctgttgctctggatctctggtgccgtacggggacgtcgtgatcgacccagtctccagacctccctggcagtgtctctgggcgggagggccaccatcaactgcaagtccagccagagttattttatacagctcctaacaataagagcgacttgcttggaccagcagaaaccaggacagcctcctaagttgctcaattttacg

SEQ ID NO: 535211 - DNA, 484 bp, Homo sapiens
  misc_feature: HIJSMM301CJFV7.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccat

SEQ ID NO: 535212 - DNA, 482 bp, Homo sapiens
  misc_feature: HIJSMM301BK6SN.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtctaggtcagcccaaggctgcccctcggtca

SEQ ID NO: 535213 - DNA, 483 bp, Homo sapiens
  misc_feature: HIJSMM301AYSQ9.46.35.D02.1.454.light.4.raw
  modified_base (407)..(407): a, c, t, g, unknown or other
actagcagtacacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattacngtcagcagtatggtcacgtcccaagaacttttggccaggggccaagctggagatcaacgaactgtggctgcaccat

SEQ ID NO: 535214 - DNA, 516 bp, Homo sapiens
  misc_feature: HIJSMM301D2TZT.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccaccctctcacg

SEQ ID NO: 535215 - DNA, 508 bp, Homo sapiens
  misc_feature: HIJSMM301ASR6S.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccgaaggtaggaaagtacaaacgaactagtggctgcaccatctgtcttcatcttccccg

SEQ ID NO: 535216 - DNA, 482 bp, Homo sapiens
  misc_feature: HIJSMM301BJVOP.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcaccat

SEQ ID NO: 535217 - DNA, 479 bp, Homo sapiens; identical to SEQ ID NO: 535118
  misc_feature: HIJSMM301BDG86.13.59.F04.1.454.light.4.raw

SEQ ID NO: 535218 - DNA, 483 bp, Homo sapiens
  misc_feature: HIJSMM301BEE4C.46.26.C04.1.454.light.4.raw
actagcagtacacgaccggtgctcgatttagtctagcgactttgggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggaccaaggtggagatcaaacgaa

SEQ ID NO: 535219 - DNA, 497 bp, Homo sapiens
  misc_feature: HIJSMM301CHX3G.16.71.G05.1.454.light.4.raw
tgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctcccgggctcctcatctatggtgcatccagcagggccactggcatcccagacaggttcagtggcagtgggtctgggacagacttcactctcaccctcagcagactggagcctgaagattttgcagtgtattactgtcagcagtatggtagggcaccttacacttttggccaggggaccaagctggagatcaaacgaactgtggctgcaccatctgtcttcta

SEQ ID NO: 535220 - DNA, 447 bp, Homo sapiens; identical to SEQ ID NO: 535020
  misc_feature: HIJSMM301CJX81.18.9.A09.1.454.light.4.raw

SEQ ID NO: 535221 - DNA, 494 bp, Homo sapiens; identical to SEQ ID NO: 534992
  misc_feature: HIJSMM301A6S60.9.1.A01.1.454.light.4.raw

SEQ ID NO: 535222 - DNA, 485 bp, Homo sapiens; identical to SEQ ID NO: 535018
  misc_feature: HIJSMM301CRX1E.46.35.D02.1.454.light.4.raw

SEQ ID NO: 535223 - DNA, 495 bp, Homo sapiens
  misc_feature: HIJSMM301D61RE.16.78.H01.1.454.light.4.raw
tgtactactccacgaccggtgctcgatttagtgtgagtagtttgggtttggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtctgcagtataataactggcctccacggtacacttttggccaggggaccaagctggagatcaaacgaactgtggctgcaccatctgt

SEQ ID NO: 535224 - DNA, 496 bp, Homo sapiens
  misc_feature: HIJSMM301AZ7HZ.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtgg

SEQ ID NO: 535225 - DNA, 448 bp, Homo sapiens
  misc_feature: HIJSMM301EDAD5.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatggatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcattctgttcccaccctcctccatactcgta

SEQ ID NO: 535226 - DNA, 450 bp, Homo sapiens
  misc_feature: HIJSMM301ECZNI.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacagtcggggcgggttatgatgtacactggtaccagcagcttccagggacacgcccccaaactcctcatctttggtagcaacaatcggccctcaggggtccctgaccgattctctggctccaagtctggcacctcagcctccctggccatcacgtgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 535227 - DNA, 452 bp, Homo sapiens
  misc_feature: HIJSMM301CE7AB.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctctccacgagagta

SEQ ID NO: 535228 - DNA, 488 bp, Homo sapiens; identical to SEQ ID NO: 535081
  misc_feature: HIJSMM301DLOTJ.26.23.C01.1.454.light.4.raw

SEQ ID NO: 535229 - DNA, 444 bp, Homo sapiens; identical to SEQ ID NO: 535192
  misc_feature: HIJSMM301BM14E.5.9.A09.1.454.light.4.raw

SEQ ID NO: 535230 - DNA, 513 bp, Homo sapiens
  misc_feature: HIJSMM301CS9T5.7.87.H10.1.454.light.4.raw
  modified_base (493)..(493): a, c, t, g, unknown or other
cgtgtctctacacgaccggtgctcgatttagcagtactgcgttgggtttggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggccaagggaccgaaggtaggaagtacaaacgaactagtggcgtgcaccatcggtntcgttcatcttcccgccact

SEQ ID NO: 535231 - DNA, 481 bp, Homo sapiens
  misc_feature: HIJSMM301CYYLT.17.26.C04.1.454.light.4.raw
cgtagactagcacgaccggtgctcgatttagtctagcgactttgggtttgggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcaccat

SEQ ID NO: 535232 - DNA, 492 bp, Homo sapiens
  misc_feature: HIJSMM301A36KE.12.38.D05.1.454.light.4.raw
atacgacgtacacgaccggtgctcgatttagtatctgatagttgggtttggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggagatcaaacgaactgtggctgcaccatctgtctcat

SEQ ID NO: 535233 - DNA, 382 bp, Homo sapiens
  misc_feature: HIJSMM301AM724.41.25.C03.1.454.light.4.raw
tctatactatcacgaccggtgctcgatttagtagtgtagatttgggtttggggaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccgaaggtggagatcaaacgaactgtggctgcaccatctgtcttcatcttcccgccatctgaatagtataga

SEQ ID NO: 535234 - DNA, 490 bp, Homo sapiens
  misc_feature: HIJSMM301BPQ4M.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtggctgca

SEQ ID NO: 535235 - DNA, 496 bp, Homo sapiens
  misc_feature: HIJSMM301DALYO.14.55.E11.1.454.light.4.raw
  modified_base (452)..(452): a, c, t, g, unknown or other
  modified_base (455)..(455): a, c, t, g, unknown or other
  modified_base (476)..(476): a, c, t, g, unknown or other
  modified_base (486)..(486): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctacttcgtcggaggacgaacgaggnganacagacgaacgtagtggcgtntcgaccactntcgtcttcta

SEQ ID NO: 535236 - DNA, 492 bp, Homo sapiens
  misc_feature: HIJSMM301DGRZR.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttactgtcagcagtatagtaactggcctccgtacacttttggccagggaccaagctagaaatcaaacgaactgtggctgcaccatctgtcttcta

SEQ ID NO: 535237 - DNA, 494 bp, Homo sapiens; identical to SEQ ID NO: 534992
  misc_feature: HIJSMM301AJX3S.9.1.A01.1.454.light.4.raw

SEQ ID NO: 535238 - DNA, 495 bp, Homo sapiens
  misc_feature: HIJSMM301B6M8Z.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaactttagtatgaggccgactatttctgtcacacgtgggacatgggcactgcgatcttcggcggagggaccaagctgaccgtcctgggtcagcccaaggctgccccctcggtcactc

SEQ ID NO: 535239 - DNA, 441 bp, Homo sapiens; identical to SEQ ID NO: 534971
  misc_feature: HIJSMM301BNIAS.11.3.A03.1.454.light.4.raw

SEQ ID NO: 535240 - DNA, 484 bp, Homo sapiens
  misc_feature: HIJSMM301DHNR2.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 535241 - DNA, 492 bp, Homo sapiens
  misc_feature: HIJSMM301AN63X.14.55.E11.1.454.light.4.raw
  modified_base (482)..(482): a, c, t, g, unknown or other
cgtctagtaccacgaccggtgctcgatttagcactcgcacgttgggtttggggagtctcaatcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcgtcggaggacgacgaggcgatcagacgaactacgtggcgtcgcgaccactntcgtcttcta

SEQ ID NO: 535242 - DNA, 381 bp, Homo sapiens
  misc_feature: HIJSMM301DW1BV.41.28.C06.1.454.light.4.raw
tctatactatcacgaccggtgctcgatttagagctcacgtattgggtttggggaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 535243 - DNA, 494 bp, Homo sapiens
  misc_feature: HIJSMM301BTQGE.22.29.C07.1.454.light.4.raw
acatacgcgtcacgaccggtgctcgatttagagtgctacgaagggaaagggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggtccaagggaccgaaggtaggaagtacaaacgaactgtggctgcaccatctgtctt

SEQ ID NO: 535244 - DNA, 513 bp, Homo sapiens
  misc_feature: HIJSMM301CIZT7.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcct

SEQ ID NO: 535245 - DNA, 401 bp, Homo sapiens
  misc_feature: HIJSMM301D65FX.4.35.D02.1.454.light.4.raw
  modified_base (371)..(371): a, c, t, g, unknown or other
agcactgtagcacgaccggtgctcgatttagcacacgatagttgggtttgggttcatgagtgcagggagacggccaggattacttgtggggagacaacattggagataaagtagtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaacccactagtnactctgttccaccctcctcctaccagtgct

SEQ ID NO: 535246 - DNA, 338 bp, Homo sapiens
  misc_feature: HIJSMM301AZSS9.49.45.E01.1.454.light.4.raw
agtcgagagacacgaccggtgctcgatttagtgagtcagtaagggaaagggcttactggtaccaacaactcccaggaacggcccccaaattcctcttgtataggagtaatcagcggccctcaggggtccctgaccgattctctggctcccagtctggcacctcagcctccctggccatcagtggcctccggtccgaggatgaggctgattattattgtgcagcatgggatgacagcctgagtggtctcgtcttcggagctgggaccaaggtcaccgtcctaggtcagcccaaggccaaccccactgtcactctgttcccaccctcctctctctcgact

SEQ ID NO: 535247 - DNA, 463 bp, Homo sapiens; identical to SEQ ID NO: 535062
  misc_feature: HIJSMM301EEXA5.11.73.G07.1.454.light.4.raw

SEQ ID NO: 535248 - DNA, 349 bp, Homo sapiens
  misc_feature: HIJSMM301ENYXD.13.11.A11.1.454.light.4.raw
tcacgtactacacgaccggtgctcgatttagctacgactgcagggccagtcagattgtcagcagcaactacttagcctggtaccagcagaagcctggccaggcccccaggctcctcatctacgatgtattcaggaggaccactggcatcccagacaggttcagtggcagtgggtctgggacagacttcactctcaccatcagcagactggaacctgaagactttgcactttattctgtcaccagtatggtaggtcaccgtacactttggccaggggaccaagctggagatcaagcgaactgtggctgcaccatctgtcttcatcttcccgccaatctgatagtacgtga

SEQ ID NO: 535249 - DNA, 447 bp, Homo sapiens; identical to SEQ ID NO: 535020
  misc_feature: HIJSMM301CDEPB.18.9.A09.1.454.light.4.raw

SEQ ID NO: 535250 - DNA, 489 bp, Homo sapiens
  misc_feature: HIJSMM301CBV9N.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatcccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttca

SEQ ID NO: 535251 - DNA, 492 bp, Homo sapiens
  misc_feature: HIJSMM301CT72T.11.71.G05.1.454.light.4.raw
cgagagataccacgaccggtgctcgatttagtgtcgtcgcaagagagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcat

SEQ ID NO: 535252 - DNA, 491 bp, Homo sapiens
  misc_feature: HIJSMM301AKA51.3.38.D05.1.454.light.4.raw
agacgcactccacgaccggtgctcgatttagtatctgatagttgggtttggggagtcagtctcagtcaggacacagcatggacatgagggtccccgctcagctcctgggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcggggaccggaacgaggtaggatactaacgaaacctgttggcgtcgtcaccta

SEQ ID NO: 535253 - DNA, 494 bp, Homo sapiens; identical to SEQ ID NO: 534994
  misc_feature: HIJSMM301BIQFY.27.78.H01.1.454.light.4.raw

SEQ ID NO: 535254 - DNA, 494 bp, Homo sapiens; identical to SEQ ID NO: 534992
  misc_feature: HIJSMM301ALAQY.9.1.A01.1.454.light.4.raw

SEQ ID NO: 535255 - DNA, 377 bp, Homo sapiens
  misc_feature: HIJSMM301ES8RL.49.42.D09.1.454.light.4.raw
agtcgagagacacgaccggtgctcgatttagacacatacgcagggaaagggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgaggtcaccgtcctgggtcagcccaaggccaacccactgtcactctgttcccaccctcctctctctcgact

SEQ ID NO: 535256 - DNA, 483 bp, Homo sapiens
  misc_feature: HIJSMM301CWTUN.47.60.F05.1.454.light.4.raw
agctcacgtacacgaccggtgctcgatttagtacgtcatcagggaaaggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 535257 - DNA, 497 bp, Homo sapiens
  misc_feature: HIJSMM301AZSBI.14.55.E11.1.454.light.4.raw
  modified_base (450)..(450): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctccacttcgtcggaggacgacgaggngatacagacgaactagtggcgtcgcaccaactctcgttctttacttt

SEQ ID NO: 535258 - DNA, 452 bp, Homo sapiens
  misc_feature: HIJSMM301AESJY.13.23.C01.1.454.light.4.raw
tcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccgactgaccgtcctcggtcagcccaaggctgccccatcggtcactctgttccccacctcctctagtacgtga

SEQ ID NO: 535259 - DNA, 501 bp, Homo sapiens
  misc_feature: HIJSMM301BA5R8.43.15.B04.1.454.light.4.raw
tgtgagtagtcacgaccggtgctcgatttagacagtatatatccgcggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggacttcggccaaggacaagtggaattcaaccgaactgtggctgcaccatctgtcttcatcttcccg

SEQ ID NO: 535260 - DNA, 504 bp, Homo sapiens
  misc_feature: HIJSMM301DKG2Z.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgtcggccaaggaccagtggagtcaagcgaactgtggctgcaccatctgtcttcatccttcccgcca

SEQ ID NO: 535261 - DNA, 517 bp, Homo sapiens
  misc_feature: HIJSMM301B7RGU.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggctgccccctcggtcactctgttcccaccctcctccacg

SEQ ID NO: 535262 - DNA, 473 bp, Homo sapiens
  misc_feature: HIJSMM301EPZFF.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtcttcatcttcccgccatctgagacacgcgag

SEQ ID NO: 535263 - DNA, 486 bp, Homo sapiens; identical to SEQ ID NO: 535043
  misc_feature: HIJSMM301A4VVE.46.35.D02.1.454.light.4.raw

SEQ ID NO: 535264 - DNA, 474 bp, Homo sapiens
  misc_feature: HIJSMM301DF9OU.13.76.G10.1.454.light.4.raw
tcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcacg

SEQ ID NO: 535265 - DNA, 471 bp, Homo sapiens
  misc_feature: HIJSMM301BCJSB.3.82.H05.1.454.light.4.raw
agacgcactccacgaccggtgctcgatttagtcgagctctctcgcgggggcaggagtcagacccacgtcaggacacagcatggacatgagggtccccgcctcagctcctggggcgtcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactatgtcaacaggctgacagtctcccgctcactttcggcggagggaccaaggtggagatcaaacgaa

SEQ ID NO: 535266 - DNA, 477 bp, Homo sapiens
  misc_feature: HIJSMM301BBNIP.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagattttgcggtttattactgtcagcagtatgataactggctgtacacttttggccaggggaccaagctggagatcaggcgaactgtgg

SEQ ID NO: 535267 - DNA, 441 bp, Homo sapiens; identical to SEQ ID NO: 534971
  misc_feature: HIJSMM301ESZCX.11.3.A03.1.454.light.4.raw

SEQ ID NO: 535268 - DNA, 453 bp, Homo sapiens
  misc_feature: HIJSMM301CWBL2.19.86.H09.1.454.light.4.raw
tactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcacaaggctgccccctcggtcactctgttcccgccctcctccacgagagta

SEQ ID NO: 535269 - DNA, 499 bp, Homo sapiens
  misc_feature: HIJSMM301ALF9Z.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatttacaagcagcaccactcaggtcttcggaactgggactaaggtcaccgtcctaggtcagcccaaggccaaccccactgtcactctgttcccaccctcctcgagtgcgtct

SEQ ID NO: 535270 - DNA, 500 bp, Homo sapiens
  misc_feature: HIJSMM301CFWKX.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaacccatgtca

SEQ ID NO: 535271 - DNA, 493 bp, Homo sapiens
  misc_feature: HIJSMM301AILHW.10.17.B06.1.454.light.4.raw
catagtagtgcacgaccggtgctcgatttagtcgatagtgaagggggaggaactgctcagttaggacccagacggaaccatggaagccccacgcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccgggggaccaagctggaaatcaagcgaactgtggctgcaccatctgtcttcat

SEQ ID NO: 535272 - DNA, 456 bp, Homo sapiens
  misc_feature: HIJSMM301AW8J9.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcacctgcactgggaacagctacaatgttggcaacgaaggagcagcttggctgcagcagtaccagggccaccctcccaaattgctatcatacaggaagaacaaccgcccctcgggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcagcccaaggctgccccctcggtcactctgttcccaccctcctcatagtataga

SEQ ID NO: 535273 - DNA, 484 bp, Homo sapiens
  misc_feature: HIJSMM301CK295.49.38.D05.1.454.light.4.raw
agtcgagagacacgaccggtgctcgatttagtatctgatagttgggtttggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggaggatcaaacg

SEQ ID NO: 535274 - DNA, 472 bp, Homo sapiens
  misc_feature: HIJSMM301BEF8K.52.49.E05.1.454.light.4.raw
cgcagtacgacacgaccggtgctcgatttagagcgactagcaacacacaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctccatacacttttggccaggggaccaagctggagatcagaacg

SEQ ID NO: 535275 - DNA, 513 bp, Homo sapiens
  misc_feature: HIJSMM301AE19I.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccgaaacgtaggagtatcaaacgaaactgtggcgtgcaccactctcgtt

SEQ ID NO: 535276 - DNA, 494 bp, Homo sapiens
  misc_feature: HIJSMM301DVJHN.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggagatcaaacgaactgtggctgcaccat

SEQ ID NO: 535277 - DNA, 497 bp, Homo sapiens
  misc_feature: HIJSMM301AIN5M.13.38.D05.1.454.light.4.raw
tcacgtactacacgaccggtgctcgatttagtatctgatagttgggtttggggagctacaacaggcaggcaggggcgagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcgggagggaccaaggtggagatcaaacgaactgt

SEQ ID NO: 535278 - DNA, 493 bp, Homo sapiens
  misc_feature: HIJSMM301A3AJI.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtca

SEQ ID NO: 535279 - DNA, 492 bp, Homo sapiens
  misc_feature: HIJSMM301B9YNC.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtcctaggtcagcccaaggctgcccctcggtca

SEQ ID NO: 535280 - DNA, 493 bp, Homo sapiens
  misc_feature: HIJSMM301A69EQ.47.78.H01.1.454.light.4.raw
agctcacgtacacgaccggtgctcgatttagtgtgagtagtttgggtttgggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttccttccatgcaaggtacacactggccttttggccaggggaccaacctggagatcaaatgaactgtggctgcaccatctgtctt

SEQ ID NO: 535281 - DNA, 467 bp, Homo sapiens
  misc_feature: HIJSMM301B699U.11.70.G04.1.454.light.4.raw
cgagagataccacgaccggtgctcgatttagtgtagtgtgaagggaaaggggcgagaagtctctctcagtcaggacacagcatggacatgagggtcccgtcgctcagctcctgggacgtcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagatagcgctgccccgctcagtttcggcggagggaccaaggtggagata

SEQ ID NO: 535282 - DNA, 495 bp, Homo sapiens
  misc_feature: HIJSMM301BXD96.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctccacttcgtcggaggacgaacggacggaggatcagacgaactagtggcgtgcaccaactctcgtcttcta

SEQ ID NO: 535283 - DNA, 494 bp, Homo sapiens
  misc_feature: HIJSMM301ELS1U.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcgcggagggaccaaggtggagatcaaacgaactgtggctgcaccatctgtcttcatcttcccgcc

SEQ ID NO: 535284 - DNA, 443 bp, Homo sapiens
  misc_feature: HIJSMM301DGR7Y.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctgagtcagcccaaggctgccccctcggtcactatgttcccaccctcctccgtgtcgat

SEQ ID NO: 535285 - DNA, 448 bp, Homo sapiens
  misc_feature: HIJSMM301EO0QO.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccaggggacagcccccaaactacctcatctttggtagcaacaatcggccctcaggggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggcaacccctctgtcactctgttcccaccctctccatactcgta

SEQ ID NO: 535286 - DNA, 497 bp, Homo sapiens
  misc_feature: HIJSMM301BXII7.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaagg

SEQ ID NO: 535287 - DNA, 484 bp, Homo sapiens
  misc_feature: HIJSMM301DH4H8.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagatttgcagtttattactgtcagcagtataataactggcctccgtacatgtacacttttggccaggggaccaacctggagat

SEQ ID NO: 535288 - DNA, 441 bp, Homo sapiens; identical to SEQ ID NO: 535074
  misc_feature: HIJSMM301AK3WZ.11.3.A03.1.454.light.4.raw

SEQ ID NO: 535289 - DNA, 466 bp, Homo sapiens
  misc_feature: HIJSMM301DGWBJ.49.27.C05.1.454.light.4.raw
agtcgagagacacgaccggtgctcgatttagacgcgatcgaagggtttggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaagtggagatcaagcgaa

SEQ ID NO: 535290 - DNA, 486 bp, Homo sapiens
  misc_feature: HIJSMM301A4PJ3.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaacgaactgtggctgcaccat

SEQ ID NO: 535291 - DNA, 480 bp, Homo sapiens
  misc_feature: HIJSMM301EF9CU.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccaggggaccaagctggagatcaaacgaa

SEQ ID NO: 535292 - DNA, 532 bp, Homo sapiens
  misc_feature: HIJSMM301EK2KL.53.77.G11.1.454.light.4.raw
cgcgtatacacacgaccggtgctcgatttagctagtcactcaagggaaaggggagtctgggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaaagtgtgcactggtaccagcagatgccaggccaggcccctgtgttggtcgtctatgatgatagcgaccggccctcaggggtccctgagcgattctctggctccaactctgggaacacggccaccctgaccataagcagggtcgaagccggggatggggccgactattactgtcaggtgtgggatactagtagtgatcatccgttgggtgttcggcggtgggaccaggctcgaccgtcctaggtcacgcccaaggctcgccccctcggtcactctcgttcccaccctcctctcg

SEQ ID NO: 535293 - DNA, 495 bp, Homo sapiens
  misc_feature: HIJSMM301B5YXQ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttctatcttccccg

SEQ ID NO: 535294 - DNA, 491 bp, Homo sapiens
  misc_feature: HIJSMM301CIF92.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatt

SEQ ID NO: 535295 - DNA, 498 bp, Homo sapiens
  misc_feature: HIJSMM301A90NJ.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactgtggctgcaccat

SEQ ID NO: 535296 - DNA, 503 bp, Homo sapiens
  misc_feature: HIJSMM301BIDM8.48.87.H10.1.454.light.4.raw
agtatacatacacgaccggtgctcgatttagcagtactgcgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 535297 - DNA, 484 bp, Homo sapiens
  misc_feature: HIJSMM301AGLZ6.10.35.D02.1.454.light.4.raw
catagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcacc

SEQ ID NO: 535298 - DNA, 489 bp, Homo sapiens
  misc_feature: HIJSMM301DY983.49.77.G11.1.454.light.4.raw
agtcgagagacacgaccggtgctcgatttagctagtcactcaagggaaaggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgt

SEQ ID NO: 535299 - DNA, 487 bp, Homo sapiens
  misc_feature: HIJSMM301EBDL5.21.55.E11.1.454.light.4.raw
tcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacacctttttaaattggtatcagcacaaaccagggaaggccccaaagctcctgatcgatgctgcatccaatttagagagtggggtcccatccaggttcagtggcgatggatctgggacaaatttcactctcaccatcagcagtctgcaacctgaagattttgcaacttactattgtcaacagagttacagtattcctttcactttcggccctgggaccgaagtcgatatcaaacgaactgtggctgcaccatctgt

SEQ ID NO: 535300 - DNA, 492 bp, Homo sapiens; identical to SEQ ID NO: 535126
  misc_feature: HIJSMM301A9K2E.18.11.A11.1.454.light.4.raw

SEQ ID NO: 535301 - DNA, 502 bp, Homo sapiens
  misc_feature: HIJSMM301BWLYS.8.19.B08.1.454.light.4.raw
ctcgcgtgtccacgaccggtgctcgatttagtgagtcagtaaggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattgagatcaaacgaactgtggctgcaccatctgtcttcatcttcccgcc

SEQ ID NO: 535302 - DNA, 470 bp, Homo sapiens
  misc_feature: HIJSMM301BV9FX.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcag

SEQ ID NO: 535303 - DNA, 493 bp, Homo sapiens; identical to SEQ ID NO: 535047
  misc_feature: HIJSMM301CW7SK.16.53.E09.1.454.light.4.raw

SEQ ID NO: 535304 - DNA, 507 bp, Homo sapiens
  misc_feature: HIJSMM301A4X9W.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctctacttcgtcggacgggacggaacgacggcggatacacgaacgaaccgtagtggtcgtcgtcgaccactacttcgtcttctt

SEQ ID NO: 535305 - DNA, 482 bp, Homo sapiens
  misc_feature: HIJSMM301BAU06.52.83.H06.1.454.light.4.raw
cgcagtacgacacgaccggtgctcgatttagatcacgtgcgtcgcgggggagtcagtcccaaccaggacacagcatggacatgagggtccctgctcagctcctggggctcctgctgctctggctctcaggtgccagatgtgacatccagatgacccagtctccatcctcactgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcggcggagggaccaaggtcgagatcaaacgaactgtggctgcaccatct

SEQ ID NO: 535306 - DNA, 493 bp, Homo sapiens
  misc_feature: HIJSMM301E08SO.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccagggaccgaagctggagatcaatcgaactgtggc

SEQ ID NO: 535307 - DNA, 484 bp, Homo sapiens
  misc_feature: HIJSMM301ERI9F.49.58.F03.1.454.light.4.raw
agtcgagagacacgaccggtgctcgatttagtctgatcgagaagggaaagggggagtcagacccagtcaggacacagcatggacatgagggtccccgctcagctcctggggctcctgctgctctggctcccaggtgccaaatgtggacatccagatgacccagtctccttcccttttgtctgcatctgttggagacagagtcaccatcacttgccgggccactgagaacattaatcgctggttggcctggtatcagcagaaaccagggaaagcccctgaggccctcatctatctggcgtctagtttagagagtggggtcccatcaagattcagcggcaatggatctgggacagagttcactctcaccatcagcagcctgcagcctgatgattttgcaacttattactgccaacagtataatagttattcgtatacttttggccaggggaccaagctggagatcaaacgaactgtggctgcacca

SEQ ID NO: 535308 - DNA, 416 bp, Homo sapiens
  misc_feature: HIJSMM301BUY6W.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccgccctcctcgagtagtaca

SEQ ID NO: 535309 - DNA, 486 bp, Homo sapiens; identical to SEQ ID NO: 535043
  misc_feature: HIJSMM301CHYAZ.46.35.D02.1.454.light.4.raw

SEQ ID NO: 535310 - DNA, 500 bp, Homo sapiens
  misc_feature: HIJSMM301BK95H.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttattactgtcagcagcgtaacaattggccgatcaccttcggccaagggacacgactggagattaaacgaactgtggctgcaccatctgtcttcatcttcccgccat

SEQ ID NO: 535311 - DNA, 463 bp, Homo sapiens; identical to SEQ ID NO: 535062
  misc_feature: HIJSMM301BA24Z.11.73.G07.1.454.light.4.raw

SEQ ID NO: 535312 - DNA, 481 bp, Homo sapiens
  misc_feature: HIJSMM301CNGUS.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttaccctcgttattttcggccccgtcggaccactagtagtatactaacaaacgtaactgtcg

SEQ ID NO: 535313 - DNA, 486 bp, Homo sapiens
  misc_feature: HIJSMM301AOJR3.47.45.E01.1.454.light.4.raw
agctcacgtacacgaccggtgctcgatttagtgagtcagtaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgt

SEQ ID NO: 535314 - DNA, 481 bp, Homo sapiens
  misc_feature: HIJSMM301DPEQZ.10.4.A04.1.454.light.4.raw
catagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcggccctcaggggtccctgagcgaatctctggcgccaagtctgggaccacaggcacgctgaccatcagtgtgacccaggctgtggatgaggcagactattactgtcaggcgtgggacagtagcgctgtgattttcggcggagggaccaagctgaccgtcctaggtcagcccaaggctgccccctc

SEQ ID NO: 535315 - DNA, 491 bp, Homo sapiens
  misc_feature: HIJSMM301B2RB9.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaaggacggagatcagacgaactgtggctgcaccatctgtcttcta

SEQ ID NO: 535316 - DNA, 507 bp, Homo sapiens
  misc_feature: HIJSMM301BRRY0.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccgaaggtggagatcaaacgaactgtggctgcaccatctgtt

SEQ ID NO: 535317 - DNA, 483 bp, Homo sapiens
  misc_feature: HIJSMM301AFFSC.4.1.A01.1.454.light.4.raw
agcactgtagcacgaccggtgctcgatttagacgtctcatcagggggaggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtggaaatcaaacgaactgtggctgcaccatctgtctt

SEQ ID NO: 535318 - DNA, 487 bp, Homo sapiens
  misc_feature: HIJSMM301A5LBX.4.64.F09.1.454.light.4.raw
agcactgtagcacgaccggtgctcgatttagcgcgtatacagggggagtcagacccacgtcaggacacagcgtggacatgagggtccccgcctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgcaacttactttgtcaacagactaactcattccctcgcagttttggccagggaccaaggtggagatcaaacgaactgtggctgcaccatctgtcttcatt

SEQ ID NO: 535319 - DNA, 499 bp, Homo sapiens
  misc_feature: HIJSMM301D1FJ5.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactgggctcaggcggaagatgaggctgactattactgtaactccgggacagcagtgctgaccaggtggtattcggcggagggacccacctgaccgtcttaggtcagcccaaggctgccccctcggtca

SEQ ID NO: 535320 - DNA, 335 bp, Homo sapiens
  misc_feature: HIJSMM301COQDN.48.85.H08.1.454.light.4.raw
agtatacatacacgaccggtgctcgatttagtatcactcagtcgcgggcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgaccgtcctaggtcagcccaaggctgccccctcggtcactctgttcccgccctcctctatgtatact

SEQ ID NO: 535321 - DNA, 465 bp, Homo sapiens
  misc_feature: HIJSMM301DKX7M.11.73.G07.1.454.light.4.raw
cgagagataccacgaccggtgctcgatttagctctacgctcaggggcgaggagtcagtcccaacccaggacacagcatggacatgagggtccctgctcagctcctggggcgtcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagacttttactctcaccatcagcagcctgcagcctgaagatattgcaacatattactgtcaacagtatgatcgtctcctcaatttcggccctggaccagagtggacatgaaacgaa

SEQ ID NO: 535322 - DNA, 494 bp, Homo sapiens
  misc_feature: HIJSMM301EKTXC.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacagtccacgagtgacccagtctccgatccgtccctaggtcctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttctactgtcaacagagttacaggcccccctataccttttggccaggggaccaagctggagatcacaggaactgtggctgcacc

SEQ ID NO: 535323 - DNA, 416 bp, Homo sapiens
  misc_feature: HIJSMM301AXNIG.16.46.E02.1.454.light.4.raw
tgtactactccacgaccggtgctcgatttagactcatctacagggaaaggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccacccctcctcgagtagtaca

SEQ ID NO: 535324 - DNA, 518 bp, Homo sapiens
  misc_feature: HIJSMM301CAQ02.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaacggaccgaaggtaggaaggtcgaaacgaactagtggcgtgcaccatctgtcttctatcttcccgtccactctgat

SEQ ID NO: 535325 - DNA, 441 bp, Homo sapiens; identical to SEQ ID NO: 534971
  misc_feature: HIJSMM301D3SL7.11.3.A03.1.454.light.4.raw

SEQ ID NO: 535326 - DNA, 497 bp, Homo sapiens
  misc_feature: HIJSMM301AUKT4.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggagtatcagacgaactagtggctg

SEQ ID NO: 535327 - DNA, 493 bp, Homo sapiens
  misc_feature: HIJSMM301DC6S7.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctggacttttggccaggggaccaagctggagatcaacgaactgtggctgcaccatctgtctt

SEQ ID NO: 535328 - DNA, 492 bp, Homo sapiens; identical to SEQ ID NO: 535126
  misc_feature: HIJSMM301DZ6PP.18.11.A11.1.454.light.4.raw

SEQ ID NO: 535329 - DNA, 497 bp, Homo sapiens
  misc_feature: HIJSMM301EPN2P.53.11.A11.1.454.light.4.raw
cgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactcttcg

SEQ ID NO: 535330 - DNA, 505 bp, Homo sapiens
  misc_feature: HIJSMM301AT3LP.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccggggccgtggacgaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctcgccccctcggta

SEQ ID NO: 535331 - DNA, 503 bp, Homo sapiens
  misc_feature: HIJSMM301CPXCB.48.34.D01.1.454.light.4.raw
agtatacatacacgaccggtgctcgatttagatcgtctgtgttgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 535332 - DNA, 498 bp, Homo sapiens
  misc_feature: HIJSMM301BHS1Q.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggaggtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccatctgac

SEQ ID NO: 535333 - DNA, 460 bp, Homo sapiens
  misc_feature: HIJSMM301BWCRR.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgggcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccgccctcctcacgcgtatgt

SEQ ID NO: 535334 - DNA, 478 bp, Homo sapiens; identical to SEQ ID NO: 535129
  misc_feature: HIJSMM301BDS5V.11.11.A11.1.454.light.4.raw

SEQ ID NO: 535335 - DNA, 492 bp, Homo sapiens
  misc_feature: HIJSMM301BY2AF.16.53.E09.1.454.light.4.raw
tgtactactccacgaccggtgctcgatttagagagagtgtgttgggtttggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactgtgg

SEQ ID NO: 535336 - DNA, 494 bp, Homo sapiens; identical to SEQ ID NO: 534992
  misc_feature: HIJSMM301BBPSB.9.1.A01.1.454.light.4.raw

SEQ ID NO: 535337 - DNA, 433 bp, Homo sapiens
  misc_feature: HIJSMM301BHBU3.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggccaggggaccaagctggagatcaaacgaactgtggctgcaccatctgtcttcatcttccgccatctgacatactcgta

SEQ ID NO: 535338 - DNA, 496 bp, Homo sapiens
  misc_feature: HIJSMM301A2251.51.78.H01.1.454.light.4.raw
cgatcgtatacacgaccggtgctcgatttagtgtgagtagtttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccacggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtca

SEQ ID NO: 535339 - DNA, 507 bp, Homo sapiens
  misc_feature: HIJSMM301AI7YT.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaaggaccgaacggtaggaaagtcaaacgaactagtggctgcaccatctgtcttctatcttccccg

SEQ ID NO: 535340 - DNA, 483 bp, Homo sapiens
  misc_feature: HIJSMM301BR5IO.13.59.F04.1.454.light.4.raw
  modified_base (475)..(475): a, c, t, g, unknown or other
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcgagggaccaaggtgcagatcaaacgaactntggctgca

SEQ ID NO: 535341 - DNA, 509 bp, Homo sapiens
  misc_feature: HIJSMM301AD8NK.8.28.C06.1.454.light.4.raw
ctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcgggagggaccgaaggtggacctcaaacgaactgtggctgcaccatctgtcttcatcttcccgcccat

SEQ ID NO: 535342 - DNA, 482 bp, Homo sapiens
  misc_feature: HIJSMM301DVPO3.51.64.F09.1.454.light.4.raw
cgatcgtatacacgaccggtgctcgatttagcgcgtatacaaggggaggaactgctcagttaggacccacgacggaaccatggaagccccacgcgcagcttctcttcctcctgctactctggctcccagacaccactggacaaatagtgatgacgcagtctccaggcaccctgtctgtgtctccaggggaaagagccaccctctcctgcagggccagtcagagtgtttctaacaacctagcctggtatcagcagaagcctggccaggctcccaggctcctcatctatggttcatccaccagggccgctgatatcccagccaggttcagtggcagtgggtctgggacagaattcactctcaccatcagcagcctgcagtctgaagattttgcagtttattactgtcagcagtatgataagtggcctccgtacacttttggccagggaccaggctggagatcaaacgaactgtggctgcaccat

SEQ ID NO: 535343 - DNA, 490 bp, Homo sapiens; identical to SEQ ID NO: 535234
  misc_feature: HIJSMM301AO9SD.17.21.B10.1.454.light.4.raw

SEQ ID NO: 535344 - DNA, 488 bp, Homo sapiens
  misc_feature: HIJSMM301BRYRD.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggttactactgcatgcagggtacactctggccgttcacttttggccagggaccaaactggatatcagacgaactgtggctgca

SEQ ID NO: 535345 - DNA, 469 bp, Homo sapiens
  misc_feature: HIJSMM301ATSJ2.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaacgttcgccaaggaccaaggtggaatcaacgaactgtggc

SEQ ID NO: 535346 - DNA, 509 bp, Homo sapiens
  misc_feature: HIJSMM301BZWUF.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctgttccgt

SEQ ID NO: 535347 - DNA, 504 bp, Homo sapiens
  misc_feature: HIJSMM301BKRRW.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgcat

SEQ ID NO: 535348 - DNA, 513 bp, Homo sapiens; identical to SEQ ID NO: 535244
  misc_feature: HIJSMM301EEBA7.17.33.C11.1.454.light.4.raw

SEQ ID NO: 535349 - DNA, 485 bp, Homo sapiens
  misc_feature: HIJSMM301DJUK1.9.64.F09.1.454.light.4.raw
tgatacgtctcacgaccggtgctcgatttagcgcgtatacaagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggtccactcagagtatgagtacttggttggcctggtatcagcagaaaccagggaaagcccctaaactcctaatctatgatgcctccattttggaaagtggggtcccatcaaggttcagcggcagtggatctgggacagaattcactctcaccatcagcagcctgcagcctgatgattttgcaacttattactgccaacgccataactggtatttcggcctgggaccaaagtggatgtcaaacgaactgtggctgcaccatctgtcttcatcttccccg

SEQ ID NO: 535350 - DNA, 491 bp, Homo sapiens
  misc_feature: HIJSMM301D670N.14.55.E11.1.454.light.4.raw
cgtctagtaccacgaccggtgctcgatttagcactcgcacgttgggtttggggagtctcagtcaggacacagcatggacatgagggtccccgctcagcttcctggggctcctgctactctggctccgaggtgccagatgtgacatccagatgacccagtctccatcctccctgtctgcatctgtaggagacagagtcaccatcacttgccgggtcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 535351 - DNA, 472 bp, Homo sapiens
  misc_feature: HIJSMM301AWPZ5.3.38.D05.1.454.light.4.raw
agacgcactccacgaccggtgctcgatttagtatctgatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagaccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcggggacgaacgtaggagatacaacgaaa

SEQ ID NO: 535352 - DNA, 482 bp, Homo sapiens
  misc_feature: HIJSMM301ES1X4.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactgtggctgcaccatctgtt

SEQ ID NO: 535353 - DNA, 488 bp, Homo sapiens
  misc_feature: HIJSMM301B4ZH6.10.2.A02.1.454.light.4.raw
catagtagtgcacgaccggtgctcgatttagactcatctacagggggaggaactgctcacttaggacccacgacggaaccatggaagccccacgcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagattttgcagtttattactgtcagcagtataatagctggcccgcgacgttcggccaagggaccgaggtggaattcaaacgaactgtggctgcaccatctgtctt

SEQ ID NO: 535354 - DNA, 501 bp, Homo sapiens
  misc_feature: HIJSMM301AXURD.11.60.F05.1.454.light.4.raw
cgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagccaccctgtctgtgtctccaggggaaagagccaccctctcctgcagggccagtcagagtattagcagcaacttagcctggtaccaacaaaaacctggccaggctcccaggctcctcttctatggtgcatccaacagggccgctggtatcccagccaggttcagtggcagtgggtctgcgacagagttcactctcaccatcagcagtctgcagtctgaagattttgcagtttattactgtcagcagtataatgactggcctcccacgtggacgttcggccgaagggaccaaggtaggaaatacaaacgaaactgtggctgcaccatctgtctt

SEQ ID NO: 535355 - DNA, 507 bp, Homo sapiens
  misc_feature: HIJSMM301BLO71.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaagtacaaacgaactagtggctgcaccatctgtcttctatcttccccg

SEQ ID NO: 535356 - DNA, 499 bp, Homo sapiens
  misc_feature: HIJSMM301ASDK3.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaaggaccgaaggagcaaatacaaacgaaactgtggctgcaccatctgtcttcatcttcccgccat

SEQ ID NO: 535357 - DNA, 484 bp, Homo sapiens
  misc_feature: HIJSMM301EBYW8.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatcaaacgactgtggctgcaccat

SEQ ID NO: 535358 - DNA, 487 bp, Homo sapiens
  misc_feature: HIJSMM301CC6LG.47.70.G04.1.454.light.4.raw
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgtt

SEQ ID NO: 535359 - DNA, 400 bp, Homo sapiens
  misc_feature: HIJSMM301DC1R1.4.35.D02.1.454.light.4.raw
agcactgtagcacgaccggtgctcgatttagcacacgatagttgggtttgggttcatgagtgcagggagacggccaggattacttgtggggagacaacattggagataaagtagtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaacccacctgtcactctgttccaccctcctcctacagtgct

SEQ ID NO: 535360 - DNA, 420 bp, Homo sapiens
  misc_feature: HIJSMM301DSD4Z.41.82.H05.1.454.light.4.raw
tctatactatcacgaccggtgctcgatttagtcgagctctctcgcgggcacgaccggtgctcgatttagtctagcgactttgggtttggggaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgcccatctgaatagtataga

SEQ ID NO: 535361 - DNA, 489 bp, Homo sapiens
  misc_feature: HIJSMM301CKCFY.16.68.G02.1.454.light.4.raw
tgtactactccacgaccggtgctcgatttagtcgatagtgaagggaaaggggagtcagacccacgtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaagtggaggtcaaacgaactgtggctgcaccatctgtcttcat

SEQ ID NO: 535362 - DNA, 489 bp, Homo sapiens
  misc_feature: HIJSMM301BRP81.49.81.H04.1.454.light.4.raw
  modified_base (473)..(473): a, c, t, g, unknown or other
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaataatgataatctaccactcactttcgtcggagggacgaccgtggaggatcaaacgaaactgtggctgnaccaatctgtcttcta

SEQ ID NO: 535363 - DNA, 485 bp, Homo sapiens
  misc_feature: HIJSMM301ERHPG.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcacca

SEQ ID NO: 535364 - DNA, 446 bp, Homo sapiens
  misc_feature: HIJSMM301B20I1.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcacgtcctaagtcagcccaaggccaacccctctgtcactctgttcccaccctcctccatactcgta

SEQ ID NO: 535365 - DNA, 454 bp, Homo sapiens; identical to SEQ ID NO: 534964
  misc_feature: HIJSMM301EFW7C.19.86.H09.1.454.light.4.raw

SEQ ID NO: 535366 - DNA, 466 bp, Homo sapiens
  misc_feature: HIJSMM301E0FPT.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaagggacacgactggagattaaacgaa

SEQ ID NO: 535367 - DNA, 516 bp, Homo sapiens
  misc_feature: HIJSMM301AXRIW.19.80.H03.1.454.light.4.raw
  modified_base (514)..(514): a, c, t, g, unknown or other
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctgttccccctcctccncg

SEQ ID NO: 535368 - DNA, 484 bp, Homo sapiens
  misc_feature: HIJSMM301AKOXH.46.35.D02.1.454.light.4.raw
actagcagtacacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgataactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgcagtctattactgtcagcagtatggtcacgtcccaagaacttttggccaggggaccaagctggagatcaaacgaactgtggctgcaccat

SEQ ID NO: 535369 - DNA, 500 bp, Homo sapiens
  misc_feature: HIJSMM301A7D35.48.76.G10.1.454.light.4.raw
agtatacatacacgaccggtgctcgatttagtcactcatacagggggaggaacccctcagttaggacccagagggaaccatggaagccccagctcagcttctcttcctcctgctactctggctcccaggttttaccggagagattgtgttgacacagtctccagtcaccctgtcattgtctccagggcaaagagccaccctctcctgcagggccaatgagagtattggcaacttcttaggctggtatcaacaaagcctggccaggctcccaggctcctcatctatgatgcatcccatagggccagaggcatcccagccaggttcagtggcagtgggtctgggacagacttcactctcaccatcggcaccctagaacgtgaagattttgcagtttattactgtcagcaccgtaaaacctggcctctgagtggttttggccaggggaccaagctggacatcaaacgaactgtggctgcaccatctgtcttcatcttcccgcc

SEQ ID NO: 535370 - DNA, 454 bp, Homo sapiens
  misc_feature: HIJSMM301DXDPL.19.86.H09.1.454.light.4.raw
tactctcgtgcacgaccggtgctcgatttagtgctatagacttggggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 535371 - DNA, 483 bp, Homo sapiens
  misc_feature: HIJSMM301A2N6B.5.39.D06.1.454.light.4.raw
atcagacacgcacgaccggtgctcgatttagtgacatctcgcagttctttggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagtttcactctcaccatcagcagcctgcagcctgatgatcttggaacttattactgccaacaatataatagttattggacgttcggccaggggaccaaggtcgaaatagagacgaactgtggctgcaccat

SEQ ID NO: 535372 - DNA, 494 bp, Homo sapiens; identical to SEQ ID NO: 534994
  misc_feature: HIJSMM301BS78Q.27.78.H01.1.454.light.4.raw

SEQ ID NO: 535373 - DNA, 491 bp, Homo sapiens; identical to SEQ ID NO: 535294
  misc_feature: HIJSMM301ENL2X.16.68.G02.1.454.light.4.raw

SEQ ID NO: 535374 - DNA, 503 bp, Homo sapiens
  misc_feature: HIJSMM301A969C.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcgagagggtcaccatctcttgttctggaggcaactccaacatcggaagtaattatgtattctggtatcagcaactcccaggaatggcccccaaacctcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaa

SEQ ID NO: 535375 - DNA, 483 bp, Homo sapiens
  misc_feature: HIJSMM301CDB0D.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggaccaaggtggaaatcaaacgaactgtggctgcacca

SEQ ID NO: 535376 - DNA, 510 bp, Homo sapiens
  misc_feature: HIJSMM301AJ80D.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccta

SEQ ID NO: 535377 - DNA, 503 bp, Homo sapiens
  misc_feature: HIJSMM301C3VB4.48.37.D04.1.454.light.4.raw
agtatacatacacgaccggtgctcgatttagtagcatactgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 535378 - DNA, 479 bp, Homo sapiens
  misc_feature: HIJSMM301BSP33.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtacatctacgagggccactggtatcccagccaggttcagtggcagtgggtctgggacagagttcactctcaccatcagcagcctgcagtctgaagattttgcagtttattactgtcagcactataataactggcctccgtacagtttggccaggggaccaagctggagatcaaacgaa

SEQ ID NO: 535379 - DNA, 492 bp, Homo sapiens; identical to SEQ ID NO: 534967
  misc_feature: HIJSMM301EP5SD.47.64.F09.1.454.light.4.raw

SEQ ID NO: 535380 - DNA, 484 bp, Homo sapiens; identical to SEQ ID NO: 535211
  misc_feature: HIJSMM301C11AX.47.46.E02.1.454.light.4.raw

SEQ ID NO: 535381 - DNA, 493 bp, Homo sapiens
  misc_feature: HIJSMM301AYLW5.13.39.D06.1.454.light.4.raw
tcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaac

SEQ ID NO: 535382 - DNA, 447 bp, Homo sapiens; identical to SEQ ID NO: 535201
  misc_feature: HIJSMM301ELYME.18.9.A09.1.454.light.4.raw

SEQ ID NO: 535383 - DNA, 477 bp, Homo sapiens; identical to SEQ ID NO: 535122
  misc_feature: HIJSMM301CLCP3.26.72.G06.1.454.light.4.raw

SEQ ID NO: 535384 - DNA, 501 bp, Homo sapiens
  misc_feature: HIJSMM301DXZ9T.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagtggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtctt

SEQ ID NO: 535385 - DNA, 486 bp, Homo sapiens
  misc_feature: HIJSMM301B5QP4.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 535386 - DNA, 489 bp, Homo sapiens
  misc_feature: HIJSMM301AFR00.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcacca

SEQ ID NO: 535387 - DNA, 493 bp, Homo sapiens
  misc_feature: HIJSMM301BNBJ2.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctcccctcctcactctctgcacaggctctgaggcctcctatgagctgacacagccaccctcggtgtcagtgtccccacggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcaaccccactgtca

SEQ ID NO: 535388 - DNA, 498 bp, Homo sapiens
  misc_feature: HIJSMM301CZW6Q.2.34.D01.1.454.light.4.raw
acgctcgacacacgaccggtgctcgatttagatcgtctgtgttgggtttggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctcggtcactctgttcccaccctcctctgtcgagcgt

SEQ ID NO: 535389 - DNA, 444 bp, Homo sapiens; identical to SEQ ID NO: 535192
  misc_feature: HIJSMM301AKHW9.5.9.A09.1.454.light.4.raw

SEQ ID NO: 535390 - DNA, 508 bp, Homo sapiens
  misc_feature: HIJSMM301EPDCC.48.11.A11.1.454.light.4.raw
agtatacatacacgaccggtgctcgatttagctacgactgcaggggctgggcccaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccgggatgaggccgactattactgtcaggtgtgggataatggtggtgatcatccggtcttcggcggagggaccaagttgaccgtcctaagtcagcccaaggctgccccctcggtcactctgttcccacctcct

SEQ ID NO: 535391 - DNA, 487 bp, Homo sapiens; identical to SEQ ID NO: 535358
  misc_feature: HIJSMM301EYXUR.47.70.G04.1.454.light.4.raw

SEQ ID NO: 535392 - DNA, 492 bp, Homo sapiens
  misc_feature: HIJSMM301CNXMZ.40.81.H04.1.454.light.4.raw
tctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgcacca

SEQ ID NO: 535393 - DNA, 498 bp, Homo sapiens; identical to SEQ ID NO: 535295
  misc_feature: HIJSMM301B2H2C.15.25.C03.1.454.light.4.raw

SEQ ID NO: 535394 - DNA, 513 bp, Homo sapiens
  misc_feature: HIJSMM301EAV3A.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgactctacctccgtccgaacggaacggacaccgtgaggaattaaacgtaaaccgtgttggcgtcgcacccaactcttcgtctttctactt

SEQ ID NO: 535395 - DNA, 454 bp, Homo sapiens; identical to SEQ ID NO: 535005
  misc_feature: HIJSMM301BNLJF.19.86.H09.1.454.light.4.raw

SEQ ID NO: 535396 - DNA, 354 bp, Homo sapiens; identical to SEQ ID NO: 535026
  misc_feature: HIJSMM301ESG8G.19.22.B11.1.454.light.4.raw

SEQ ID NO: 535397 - DNA, 497 bp, Homo sapiens; identical to SEQ ID NO: 534982
  misc_feature: HIJSMM301BH9EZ.26.80.H03.1.454.light.4.raw

SEQ ID NO: 535398 - DNA, 455 bp, Homo sapiens
  misc_feature: HIJSMM301BT1CS.19.86.H09.1.454.light.4.raw
tactctcgtgcacgaccggtgctcgatttagtgctatagacttgggtttgggggccgttcctgggcccagtctgtgctgactcaggcaccctcagagtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggtttttcggcggagggaccaagctgaccgtcctaagtcagcccaaggctgccccctcggtcactctgttcccaccctcctccacgagagta

SEQ ID NO: 535399 - DNA, 483 bp, Homo sapiens
  misc_feature: HIJSMM301BUU5O.46.35.D02.1.454.light.4.raw
actagcagtacacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatcaacgaactgtggctgcaccat

SEQ ID NO: 535400 - DNA, 484 bp, Homo sapiens
  misc_feature: HIJSMM301B2AP8.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 535401 - DNA, 510 bp, Homo sapiens
  misc_feature: HIJSMM301A89P8.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccacccctgaccatcagcagggtcggaagccggggagtgaggccgactattactgtcaggtgtgggatagtagtggtgatcatccataacgtcttcggaactgggaccgaaggtctccgtcctacgtcagcccaacggccaactccactgtcact

SEQ ID NO: 535402 - DNA, 489 bp, Homo sapiens
  misc_feature: HIJSMM301DCEI0.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaagg

SEQ ID NO: 535403 - DNA, 486 bp, Homo sapiens
  misc_feature: HIJSMM301CUTY2.4.64.F09.1.454.light.4.raw
agcactgtagcacgaccggtgctcgatttagcgcgtatacaaggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgcaacttactttgtcaacagactaactcattccctcgcagttttggccaggggaccaaggtggaggatcaaacgaactgtggctgcaccatctgtcttcat

SEQ ID NO: 535404 - DNA, 506 bp, Homo sapiens
  misc_feature: HIJSMM301C4Q0X.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccgggaccaaagtggaaatcaaacgaactgtggctgcaccatctgtcttcatcttcccgcc

SEQ ID NO: 535405 - DNA, 448 bp, Homo sapiens
  misc_feature: HIJSMM301ARLSB.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatcgtgggaccaaggtcaccgtcctaagtcagcccaaggccaacccctctgtcactctgttcccgccctcctccatactcgta

SEQ ID NO: 535406 - DNA, 511 bp, Homo sapiens
  misc_feature: HIJSMM301D0S1Z.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcact

SEQ ID NO: 535407 - DNA, 518 bp, Homo sapiens
  misc_feature: HIJSMM301EKVF8.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctcacg

SEQ ID NO: 535408 - DNA, 486 bp, Homo sapiens
  misc_feature: HIJSMM301BPW3H.12.31.C09.1.454.light.4.raw
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaagcaggcaaagtcccaaagctcctgatttatgctgccaccagtctgcaaggtggttcccgtcaaggttcactggccgtggatcagggacagaatttactctcaccatcagtagtctacagcctgaagatattgctacttattactgtcagcagagttaccgcgctcccatcactttcggccaagggacacgaccgcagattggacgaactgtggctgcacc

SEQ ID NO: 535409 - DNA, 480 bp, Homo sapiens
  misc_feature: HIJSMM301C9LOT.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaaggtggaaatcaaacgaactgtggctgcacca

SEQ ID NO: 535410 - DNA, 481 bp, Homo sapiens
  misc_feature: HIJSMM301B311D.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggagggaccaaggtggagatcaaacgaactgtggctgcacc

SEQ ID NO: 535411 - DNA, 444 bp, Homo sapiens
  misc_feature: HIJSMM301AT8JC.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgccctcctcgacacgcgag

SEQ ID NO: 535412 - DNA, 454 bp, Homo sapiens
  misc_feature: HIJSMM301BXS8H.19.86.H09.1.454.light.4.raw
tactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgaccctcctccacgagagta

SEQ ID NO: 535413 - DNA, 483 bp, Homo sapiens
  misc_feature: HIJSMM301CRDHL.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaa

SEQ ID NO: 535414 - DNA, 486 bp, Homo sapiens
  misc_feature: HIJSMM301AF31W.41.80.H03.1.454.light.4.raw
tctatactatcacgaccggtgctcgatttagctgtgcgtcgaagggaaagggggagtcagtcccaaccaggacacagcatggacatgagggtccctgctcagcttctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggtcggagggaccgaaggtggaggatcaaacgaactgtggctgcacca

SEQ ID NO: 535415 - DNA, 502 bp, Homo sapiens
  misc_feature: HIJSMM301C51IC.13.53.E09.1.454.light.4.raw
  modified_base (457)..(457): a, c, t, g, unknown or other
tcacgtactacacgaccggtgctcgatttagagagagtgtgttgggtttggggagtcagtctcagtcaggacacagcatggacatgagggtccccgcctcagctcctggggcgtcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctccccggacgtcgtcaggacacgaggaagtanagacgaactgtggcgtgcgaccactctgtcttctactcttcccgt

SEQ ID NO: 535416 - DNA, 479 bp, Homo sapiens; identical to SEQ ID NO: 535118
  misc_feature: HIJSMM301CZFSV.13.59.F04.1.454.light.4.raw

SEQ ID NO: 535417 - DNA, 464 bp, Homo sapiens
  misc_feature: HIJSMM301AV3UC.11.73.G07.1.454.light.4.raw
cgagagataccacgaccggtgctcgatttagctctacgctcagggggcaggagtcagtcccaacccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccagagtggacatgaaacgaa

SEQ ID NO: 535418 - DNA, 507 bp, Homo sapiens
  misc_feature: HIJSMM301BW4AT.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctgtttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactgtggctgcaccatctgtcttcatcttcccgcc

SEQ ID NO: 535419 - DNA, 515 bp, Homo sapiens
  misc_feature: HIJSMM301D4F12.47.53.E09.1.454.light.4.raw
agctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatattttgtcaggtgtgggagactaatttggtcatatgttgttcggcggagggaccaagctgaccgtcctcggtcagcccaaggctgccccctcggtcactctgttcccgccct

SEQ ID NO: 535420 - DNA, 490 bp, Homo sapiens
  misc_feature: HIJSMM301A2UF0.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccaaggtggagatcaaacgaactgtggctgcaccatctgt

SEQ ID NO: 535421 - DNA, 441 bp, Homo sapiens; identical to SEQ ID NO: 535074
  misc_feature: HIJSMM301BM0QX.11.3.A03.1.454.light.4.raw

SEQ ID NO: 535422 - DNA, 488 bp, Homo sapiens
  misc_feature: HIJSMM301AREVZ.48.84.H07.1.454.light.4.raw
agtatacatacacgaccggtgctcgatttagcagacgtctgtcgcgggcacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattcttcggaccttcgccaacggaccgacggta

SEQ ID NO: 535423 - DNA, 496 bp, Homo sapiens
  misc_feature: HIJSMM301AJJAW.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgccctcctcgagtgcgtct

SEQ ID NO: 535424 - DNA, 492 bp, Homo sapiens
  misc_feature: HIJSMM301AFFB5.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggcgtgaggatgttggcatttattacttgcatgcaggctatacaccttcctgccacttttggtccaggggaccgaagctggagatcaggcgaacg

SEQ ID NO: 535425 - DNA, 492 bp, Homo sapiens
  misc_feature: HIJSMM301BCLWI.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctggtcact

SEQ ID NO: 535426 - DNA, 492 bp, Homo sapiens
  misc_feature: HIJSMM301DNBBX.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttgggtttgttcctccatgcaaggtacacactggccttttggccaggggaccaacctggagatcaaatgaactgtggctgcaccatctgtctt

SEQ ID NO: 535427 - DNA, 494 bp, Homo sapiens
  misc_feature: HIJSMM301DS9LH.51.84.H07.1.454.light.4.raw
cgatcgtatacacgaccggtgctcgatttagcagacgtctgtcgcggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaactgtggctgcaccatctgtcttcat

SEQ ID NO: 535428 - DNA, 444 bp, Homo sapiens; identical to SEQ ID NO: 534993
  misc_feature: HIJSMM301EPES6.5.9.A09.1.454.light.4.raw

SEQ ID NO: 535429 - DNA, 503 bp, Homo sapiens
  misc_feature: HIJSMM301EIVOO.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcaggtcgaagccggggatgaggccgactattactgtcaggtgtgggatagtagtggtgatcatccatacgtcttcggaactgggaccaaggtctccgtcctacgtcagcccaaggccaactccactgtcact

SEQ ID NO: 535430 - DNA, 503 bp, Homo sapiens
  misc_feature: HIJSMM301EIJAE.48.62.F07.1.454.light.4.raw
agtatacatacacgaccggtgctcgatttagtagtcgcataaagggaaagggggcatgagcaaaactagacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtacttttagtttacgtcggaccttcggccaagggacacgactggagaattaacgaactgtggctgcaccatctgtcttcactcttcccg

SEQ ID NO: 535431 - DNA, 497 bp, Homo sapiens
  misc_feature: HIJSMM301CYLJU.19.71.G05.1.454.light.4.raw
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgaggcggccaccagtcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggaacagatttcactctcaccatcagcagcctgcaggctgaagatgtggcagtttattatgtcaacaatattattataccttcgtggacgttcggccaaggaccaaggtggatatccagacgaactgtggcgtgca

SEQ ID NO: 535432 - DNA, 523 bp, Homo sapiens
  misc_feature: HIJSMM301DDOEP.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctacttcgttcggacgggacggaacgacggcggaagtactacgaacgaaccgtaacgttgggtcggtcgtcgaccaacctacttcgttcgttcctta

SEQ ID NO: 535433 - DNA, 496 bp, Homo sapiens
  misc_feature: HIJSMM301AG6GC.43.55.E11.1.454.light.4.raw
tgtgagtagtcacgaccggtgctcgatttagcactcgcacgttgggtttggggagtcagacccagtcaggacacagcatggacatgagggtccccgctcagctcctggggcgtcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaaggacgaacgtaggaaagtacaaacgaactgtggctgcaccatctgtcttcat

SEQ ID NO: 535434 - DNA, 415 bp, Homo sapiens
  misc_feature: HIJSMM301C28Z1.16.46.E02.1.454.light.4.raw
tgtactactccacgaccggtgctcgatttagactcatctacagggaaaggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccaccctcctcgagtagtaca

SEQ ID NO: 535435 - DNA, 440 bp, Homo sapiens
  misc_feature: HIJSMM301A9TQU.17.11.A11.1.454.light.4.raw
cgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacacctacttgaattggtttcaacagaggccaggccaatctccaaggcgcctaatttataaggtttctaaccgggactctggggtcccagacagattcagcggtagtgggtcaggcactgatttcacactgagaatcagcagggtggaggctgaggatgttggggtttattactgcttgcaaggtacacactggtacacttttggccaggggaccaagctggagatcaaacgaactgtggctgcaccatctgtcttcatcttcccgccatctgactagtctacg

SEQ ID NO: 535436 - DNA, 486 bp, Homo sapiens; identical to SEQ ID NO: 535043
  misc_feature: HIJSMM301ESZ8W.46.35.D02.1.454.light.4.raw

SEQ ID NO: 535437 - DNA, 513 bp, Homo sapiens; identical to SEQ ID NO: 535244
  misc_feature: HIJSMM301B9BFJ.17.33.C11.1.454.light.4.raw

SEQ ID NO: 535438 - DNA, 444 bp, Homo sapiens
  misc_feature: HIJSMM301C2HOU.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccaccctcttcagacgtatca

SEQ ID NO: 535439 - DNA, 434 bp, Homo sapiens; identical to SEQ ID NO: 535153
  misc_feature: HIJSMM301EO2R3.18.5.A05.1.454.light.4.raw

SEQ ID NO: 535440 - DNA, 444 bp, Homo sapiens; identical to SEQ ID NO: 535411
  misc_feature: HIJSMM301DZEAV.8.73.G07.1.454.light.4.raw

SEQ ID NO: 535441 - DNA, 484 bp, Homo sapiens
  misc_feature: HIJSMM301B4HJV.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 535442 - DNA, 480 bp, Homo sapiens
  misc_feature: HIJSMM301AXUM7.41.17.B06.1.454.light.4.raw
tctatactatcacgaccggtgctcgatttagtcgatagtgaagggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttactctcaccatcaacggcctgcagtctgaagattctgcagtttattactgtcagcagtatgttgactggcctccgctcactttcggcggagggaccaaggtggagatcagacgaactgtggctgcacc

SEQ ID NO: 535443 - DNA, 521 bp, Homo sapiens
  misc_feature: HIJSMM301C2RK5.49.9.A09.1.454.light.4.raw
agtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggccaccctgaccgtcagcagggtcgaagccggggatgaggccgactatatctgtcaggtgtgggatagtagtagtgctcttccgggggtgttcggcggagggaccaagttgaccgtcgttggtcagcccaaggctgccccctggtcactctgttcccgccctcctctctctcga

SEQ ID NO: 535444 - DNA, 493 bp, Homo sapiens
  misc_feature: HIJSMM301ANWBG.3.3.A03.1.454.light.4.raw
agacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccactggcatcccagccaggttcagtggcagtgggtctgggacagacttcactctcaccatcagtagcctagagcctgaagattttgcagtctattattgtcaacagcgtggcaactggccctcgtggacgttcggtccaagggaccaaggtggaaatcaaccgaactgtggctgcaccatctgtcttcat

SEQ ID NO: 535445 - DNA, 447 bp, Homo sapiens; identical to SEQ ID NO: 535201
  misc_feature: HIJSMM301CWFZ4.18.9.A09.1.454.light.4.raw

SEQ ID NO: 535446 - DNA, 504 bp, Homo sapiens
  misc_feature: HIJSMM301EDNM0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctccggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccaaggtggaaatacaaacgaaactgtggctgcaccatctgtcttcatcttcccg

SEQ ID NO: 535447 - DNA, 455 bp, Homo sapiens
  misc_feature: HIJSMM301CKK9H.19.71.G05.1.454.light.4.raw
tactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgcaccatctgtcttcatcttcccgccatctgacacgagagta

SEQ ID NO: 535448 - DNA, 483 bp, Homo sapiens; identical to SEQ ID NO: 535413
  misc_feature: HIJSMM301AOJO7.26.78.H01.1.454.light.4.raw

SEQ ID NO: 535449 - DNA, 478 bp, Homo sapiens
  misc_feature: HIJSMM301DXTVD.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccg

SEQ ID NO: 535450 - DNA, 486 bp, Homo sapiens
  misc_feature: HIJSMM301DB5NP.47.68.G02.1.454.light.4.raw
agctcacgtacacgaccggtgctcgatttagtcgatagtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgt

SEQ ID NO: 535451 - DNA, 487 bp, Homo sapiens
  misc_feature: HIJSMM301ESWHF.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcgtcggaggacgaacgacggagatcagagaactgtggctgcaccactctgtcttcta

SEQ ID NO: 535452 - DNA, 512 bp, Homo sapiens
  misc_feature: HIJSMM301CO2HY.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtcgtctgat

SEQ ID NO: 535453 - DNA, 503 bp, Homo sapiens
  misc_feature: HIJSMM301A0V2A.8.28.C06.1.454.light.4.raw
ctcgcgtgtccacgaccggtgctcgatttagagctcacgtattgggtttgggggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgccat

SEQ ID NO: 535454 - DNA, 497 bp, Homo sapiens
  misc_feature: HIJSMM301BQ5X3.10.82.H05.1.454.light.4.raw
catagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatcccaggaggtgcccccaaactcctcatatatgaagatgataagcgaccgtcagggattcctgaccgattctctggctccaagtctggcacgtcggccaccctgggcatcgccggactccagactggggacgaggccgattttactgcggaacatgggataccagcctgcatggtgtggttttcggcggagggaccaagctgaccgtcctaagtcagcccaaggcct

SEQ ID NO: 535455 - DNA, 507 bp, Homo sapiens
  misc_feature: HIJSMM301BY140.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgccat

SEQ ID NO: 535456 - DNA, 476 bp, Homo sapiens
  misc_feature: HIJSMM301AFR3Q.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggaggaccgaaggtggagatacaacgaactgtggctgcaccatctgt

SEQ ID NO: 535457 - DNA, 509 bp, Homo sapiens
  misc_feature: HIJSMM301BUE98.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttccca

SEQ ID NO: 535458 - DNA, 486 bp, Homo sapiens
  misc_feature: HIJSMM301AHFMI.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtggctgcaccatctgtt

SEQ ID NO: 535459 - DNA, 490 bp, Homo sapiens; identical to SEQ ID NO: 535234
  misc_feature: HIJSMM301CKNL8.17.21.B10.1.454.light.4.raw

SEQ ID NO: 535460 - DNA, 496 bp, Homo sapiens
  misc_feature: HIJSMM301BHUJH.10.20.B09.1.454.light.4.raw
catagtagtgcacgaccggtgctcgatttagtgtagtgtgaaggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggtccctcgggaccaaagtggatttctagacggaactgtggctgcaccatctgtcttccta

SEQ ID NO: 535461 - DNA, 483 bp, Homo sapiens
  misc_feature: HIJSMM301AHOS5.10.73.G07.1.454.light.4.raw
catagtagtgcacgaccggtgctcgatttagctctacgctcagggggagtcagtctcagtcaggacacagcatggacatgagggtccccgctcagctcctggggctcctgctactctggctccgaggtgccagatgtgacatccaaatgacccagtctccatcctccctgtctgcatctttaggcgacagagtcaccattacttgccgggcaagtcagagcattaccaactctttaaattggtttcaacagaggccagggaaagcccctaagctcctggtctatggtgcatccactgtgcaaactggggtcccatccaggttcagtggcagtggatttgggacagatttcactctcaccatcaacaatctgcagcctgatgatttcgcaacttactactgtcaacagagttacacgacgccaatcactttcggccctcgggaccaaagtggatatcaagcgaactgtggctgcaccatctgtt

SEQ ID NO: 535462 - DNA, 488 bp, Homo sapiens
  misc_feature: HIJSMM301DM3HD.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgcaaggtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttggccaagggaccaaggtggatatcagacgaa

SEQ ID NO: 535463 - DNA, 502 bp, Homo sapiens
  misc_feature: HIJSMM301BKQWI.43.86.H09.1.454.light.4.raw
tgtgagtagtcacgaccggtgctcgatttagtgctatagacttgggtttggggtgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattactgcatgcaaacttcacactggcctccgttcacttttggccaggggaccaaggtggagatcaaacgaactgtggctgcaccat

SEQ ID NO: 535464 - DNA, 480 bp, Homo sapiens; identical to SEQ ID NO: 535442
  misc_feature: HIJSMM301AMUFC.41.17.B06.1.454.light.4.raw

SEQ ID NO: 535465 - DNA, 498 bp, Homo sapiens
  misc_feature: HIJSMM301CZ1J4.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcatcatctgt

SEQ ID NO: 535466 - DNA, 507 bp, Homo sapiens
  misc_feature: HIJSMM301D68BV.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccgaaggaccgaaggtggaaagtacaaacgaactagtggctgcaccaatctgtcttctatcttccccg

SEQ ID NO: 535467 - DNA, 494 bp, Homo sapiens; identical to SEQ ID NO: 534994
  misc_feature: HIJSMM301BL79E.27.78.H01.1.454.light.4.raw

SEQ ID NO: 535468 - DNA, 494 bp, Homo sapiens
  misc_feature: HIJSMM301EHEB4.52.51.E07.1.454.light.4.raw
cgcagtacgacacgaccggtgctcgatttagcatactctacaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgt

SEQ ID NO: 535469 - DNA, 498 bp, Homo sapiens
  misc_feature: HIJSMM301AIHDX.12.18.B07.1.454.light.4.raw
atacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagagcctgaagattttggaatttattactgtcaacagcgtagcaactggcctcccactttcggcggagggaccaaggtggagatcaagcgaactgtggctgcaccatctgtcttcatcttcccgcc

SEQ ID NO: 535470 - DNA, 505 bp, Homo sapiens
  misc_feature: HIJSMM301B0CTG.19.67.G01.1.454.light.4.raw
  modified_base (468)..(468): a, c, t, g, unknown or other
tactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttccccaccattgtgatctatgaggataatcaaagaccgtctggggtccctgatcggttctctggctccaatcgacagctcctccaactctgcctccctcaccatctctggactgaagactgaggacgaggctgactactactgtcagtcttatgatagccgcggtcatgtggtcttcggcggagggaccaacgntgaccgtccctaggtcagcccaaaggctgccccctcc

SEQ ID NO: 535471 - DNA, 495 bp, Homo sapiens
  misc_feature: HIJSMM301AZY2B.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtagatcaccttcggccaagggacacgactggagattaaacgaactgtggctgcaccatctgtctt

SEQ ID NO: 535472 - DNA, 491 bp, Homo sapiens
  misc_feature: HIJSMM301CN80G.13.5.A05.1.454.light.4.raw
tcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaataccaggcggccctctggggtccctgagcgattctccggctccgcctctgggaacacagtcactctgaccatcagcgggacccagcctattgatgaggctgtctacttctgtcaggcgtgggacaacagcgtgctgttcggcggagggaccagtctgaccgtcttaggtcagcccaaggctgccccctcggtcactctgttcc

SEQ ID NO: 535473 - DNA, 489 bp, Homo sapiens
  misc_feature: HIJSMM301DGOVA.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtgaggaccaaggtggaggtcaaacgaactgtggctgcaccatctgtcttcatt

SEQ ID NO: 535474 - DNA, 510 bp, Homo sapiens
  misc_feature: HIJSMM301DSP5I.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccg

SEQ ID NO: 535475 - DNA, 443 bp, Homo sapiens
  misc_feature: HIJSMM301DRBGX.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctctcgacacgcgag

SEQ ID NO: 535476 - DNA, 447 bp, Homo sapiens; identical to SEQ ID NO: 535201
  misc_feature: HIJSMM301DMNZK.18.9.A09.1.454.light.4.raw

SEQ ID NO: 535477 - DNA, 494 bp, Homo sapiens; identical to SEQ ID NO: 534992
  misc_feature: HIJSMM301AJRUI.9.1.A01.1.454.light.4.raw

SEQ ID NO: 535478 - DNA, 494 bp, Homo sapiens
  misc_feature: HIJSMM301BR308.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtctt

SEQ ID NO: 535479 - DNA, 449 bp, Homo sapiens
  misc_feature: HIJSMM301AFQ7C.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtcccgtcgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 535480 - DNA, 483 bp, Homo sapiens
  misc_feature: HIJSMM301DDKB0.46.26.C04.1.454.light.4.raw
actagcagtacacgaccggtgctcgatttagtctagcgactttgggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 535481 - DNA, 486 bp, Homo sapiens
  misc_feature: HIJSMM301CI3B7.17.21.B10.1.454.light.4.raw
cgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtgg

SEQ ID NO: 535482 - DNA, 494 bp, Homo sapiens; identical to SEQ ID NO: 535478
  misc_feature: HIJSMM301C4Q5P.10.79.H02.1.454.light.4.raw

SEQ ID NO: 535483 - DNA, 416 bp, Homo sapiens
  misc_feature: HIJSMM301C97FR.16.46.E02.1.454.light.4.raw
tgtactactccacgaccggtgctcgatttagactcatctacagggaaaggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaattacttttgtcttcggaactgggaccaaggtcaccgtcctaggtcagcccaaggccaaccccactgtcactctgttcccaccctcctcgagtagtaca

SEQ ID NO: 535484 - DNA, 512 bp, Homo sapiens
  misc_feature: HIJSMM301CBCEM.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaaccccactgtcactctgttcccaccctcctcga

SEQ ID NO: 535485 - DNA, 480 bp, Homo sapiens
  misc_feature: HIJSMM301DI190.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactgtggctgcac

SEQ ID NO: 535486 - DNA, 495 bp, Homo sapiens
  misc_feature: HIJSMM301AWPE9.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagacgaactgtggctgcaccatctgtcttcatcttcccg

SEQ ID NO: 535487 - DNA, 484 bp, Homo sapiens; identical to SEQ ID NO: 535441
  misc_feature: HIJSMM301CH6ZZ.26.60.F05.1.454.light.4.raw

SEQ ID NO: 535488 - DNA, 490 bp, Homo sapiens
  misc_feature: HIJSMM301BKOH1.41.72.G06.1.454.light.4.raw
tctatactatcacgaccggtgctcgatttagctacgactgcaagggaaaggggaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcatgggacagcagcctcacaaattggatgttcggcggagggaccaagctgaccgtcctaggtcagcccaagg

SEQ ID NO: 535489 - DNA, 480 bp, Homo sapiens
  misc_feature: HIJSMM301DASQ2.52.1.A01.1.454.light.4.raw
cgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctcgggaccgatagtggataatcaaacgaaactgtggctgcaccatctgtcttcatcttcccgcccat

SEQ ID NO: 535490 - DNA, 486 bp, Homo sapiens
  misc_feature: HIJSMM301AQICV.13.87.H10.1.454.light.4.raw
  modified_base (484)..(484): a, c, t, g, unknown or other
tcacgtactacacgaccggtgctcgatttagcagtactgcgttgggtttgggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtgtggagtactaacgaagcgtaagtcgtggcncg

SEQ ID NO: 535491 - DNA, 495 bp, Homo sapiens
  misc_feature: HIJSMM301CYJAW.3.33.C11.1.454.light.4.raw
agacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctcctcgagtgcgtct

SEQ ID NO: 535492 - DNA, 493 bp, Homo sapiens
  misc_feature: HIJSMM301DFHLK.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaagggaccaaggtggaagtcaaacgaactagtggctgcaccatctgtcttt

SEQ ID NO: 535493 - DNA, 416 bp, Homo sapiens
  misc_feature: HIJSMM301AIJNC.18.78.H01.1.454.light.4.raw
tacgagtatgcacgaccggtgctcgatttagtgtgagtagtttgggtttgggggcgtttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtcactctgttcccaccctcctccatactcgta

SEQ ID NO: 535494 - DNA, 487 bp, Homo sapiens
  misc_feature: HIJSMM301BR7EW.49.64.F09.1.454.light.4.raw
agtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggtcggagggaccaaggtggagatcaaaagaactgtggctgcaccatctgtcttca

SEQ ID NO: 535495 - DNA, 504 bp, Homo sapiens
  misc_feature: HIJSMM301C2RMZ.14.86.H09.1.454.light.4.raw
cgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagctccctagagcctggagattttgtagtttattactgtcagcagtatagcagctggcctcccactttcggcggagggaccaaggtggagatccaacgaactgtggctgcaccatctgtcttcatcttccccg

SEQ ID NO: 535496 - DNA, 484 bp, Homo sapiens; identical to SEQ ID NO: 535400
  misc_feature: HIJSMM301CPFIG.46.26.C04.1.454.light.4.raw

SEQ ID NO: 535497 - DNA, 494 bp, Homo sapiens
  misc_feature: HIJSMM301CDP3K.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtcctaggtcagcccaaggctgccccctcggtcta

SEQ ID NO: 535498 - DNA, 484 bp, Homo sapiens
  misc_feature: HIJSMM301B7EOR.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctcccactttcggccctggaccaaagtggatatcaaacgaactgtggctgcaccatctgtt

SEQ ID NO: 535499 - DNA, 447 bp, Homo sapiens
  misc_feature: HIJSMM301C4PSZ.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaagtcaccgtcctaagtcagcccaaggccaacccctctgtcactctgttcccgccctcctccatactcgta

SEQ ID NO: 535500 - DNA, 501 bp, Homo sapiens
  misc_feature: HIJSMM301EKRMD.15.25.C03.1.454.light.4.raw
tctacgtagccacgaccggtgctcgatttagtagtgtagatttgggtttgggggagtcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatacagcagagtggaggctgagggacgttggggtttattactgcatgcaaggtctacaaaccccgatcaccttcggccgagggacacgcctggagattaaacgaactgtggctgcaccat

SEQ ID NO: 535501 - DNA, 485 bp, Homo sapiens
  misc_feature: HIJSMM301A7RR5.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaa

SEQ ID NO: 535502 - DNA, 522 bp, Homo sapiens
  misc_feature: HIJSMM301B9GEW.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgactctacctccggtccgaacggaacggacaaccgtggtaggaattaaacgtaaaaccgtagttgggtcgtcgcgacccaactcttcgttctttccta

SEQ ID NO: 535503 - DNA, 505 bp, Homo sapiens
  misc_feature: HIJSMM301A33QG.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcc

SEQ ID NO: 535504 - DNA, 483 bp, Homo sapiens
  misc_feature: HIJSMM301AJGKL.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcacttcggcggagggaccaaggtggagatcaaacgaa

SEQ ID NO: 535505 - DNA, 512 bp, Homo sapiens
  misc_feature: HIJSMM301BBYEL.47.85.H08.1.454.light.4.raw
agctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagtgaccgtcctaggtcagcccaaggctgccccctcggtcactctgttccccg

SEQ ID NO: 535506 - DNA, 477 bp, Homo sapiens
  misc_feature: HIJSMM301DD525.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagcctccctggccatcactgggctccaggctgaggatgaggctgattattactgccagtcgtatgacagcagcctgagtgtttgggtgttcggcggaggga

SEQ ID NO: 535507 - DNA, 490 bp, Homo sapiens
  misc_feature: HIJSMM301D1RG3.41.23.C01.1.454.light.4.raw
tctatactatcacgaccggtgctcgatttagtacacgtgattagggattggggtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagggaccaagctgaccgtccttggtcagccaaggctgccccctc

SEQ ID NO: 535508 - DNA, 487 bp, Homo sapiens
  misc_feature: HIJSMM301BOMJQ.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgt

SEQ ID NO: 535509 - DNA, 501 bp, Homo sapiens
  misc_feature: HIJSMM301CZNN5.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgccccctcggtcactctgttcccgccctcctcgctacgtaga

SEQ ID NO: 535510 - DNA, 448 bp, Homo sapiens
  misc_feature: HIJSMM301BI0SU.18.73.G07.1.454.light.4.raw
tacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggcacctcagcctccctggccatcactgggctccaggctgatgatgaggctgattattactgccagtcctatgacatgaggctgagtggttcgtatgtcttcggatctgggaccaaggtcaccgtcctaagtcagtcccaaggccaacccctctgtcactctgttcccaccctcctccatactcgta

SEQ ID NO: 535511 - DNA, 505 bp, Homo sapiens
  misc_feature: HIJSMM301DB1QU.11.57.F02.1.454.light.4.raw
  modified_base (473)..(473): a, c, t, g, unknown or other
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggaagtcagcgaacngtggctgcaccatctgtcttcatcttcccgtc

SEQ ID NO: 535512 - DNA, 488 bp, Homo sapiens
  misc_feature: HIJSMM301D2Z9Q.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggccaagctggagatcaaacgaactgtggctgcacca

SEQ ID NO: 535513 - DNA, 499 bp, Homo sapiens
  misc_feature: HIJSMM301BEM3X.43.41.D08.1.454.light.4.raw
tgtgagtagtcacgaccggtgctcgatttagtcacgcgagaaagggaaaggggagctacaacaggcaggcaggggcgagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccgaaggaccaaggtggaaatcagacgaactgtggctgcacc

SEQ ID NO: 535514 - DNA, 486 bp, Homo sapiens; identical to SEQ ID NO: 535043
  misc_feature: HIJSMM301BHBN5.46.35.D02.1.454.light.4.raw

SEQ ID NO: 535515 - DNA, 354 bp, Homo sapiens; identical to SEQ ID NO: 535026
  misc_feature: HIJSMM301DI2WE.19.22.B11.1.454.light.4.raw

SEQ ID NO: 535516 - DNA, 470 bp, Homo sapiens
  misc_feature: HIJSMM301BH5PU.5.28.C06.1.454.light.4.raw
atcagacacgcacgaccggtgctcgatttagagctcacgtattgggtttggggcaggagtcagtcccaacccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccaaggtggagatcgaacgaa

SEQ ID NO: 535517 - DNA, 520 bp, Homo sapiens
  misc_feature: HIJSMM301BYSA8.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgaacggaccgaacggtaggaaggtacgaaacgaacctagtggcgtgcaccactctgtcttctactcttcccgtcccact

SEQ ID NO: 535518 - DNA, 508 bp, Homo sapiens
  misc_feature: HIJSMM301BLMKW.22.65.F10.1.454.light.4.raw
  modified_base (477)..(477): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgactacacctccgtccgaacggaacgacacgtagtaggaattaaacgtaaaccngttggcgtcgcgaccactctcgtcttcctat

SEQ ID NO: 535519 - DNA, 517 bp, Homo sapiens
  misc_feature: HIJSMM301CMBB9.22.65.F10.1.454.light.4.raw
  modified_base (504)..(504): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccactctacctaccgtccgaacggaacggaccacgtacgtaggaattaaacgtaaaccgtattgggcgtcgtcgaccaacctnttcgttcttccta

SEQ ID NO: 535520 - DNA, 507 bp, Homo sapiens
  misc_feature: HIJSMM301DHYMY.9.27.C05.1.454.light.4.raw
  modified_base (464)..(464): a, c, t, g, unknown or other
tgatacgtctcacgaccggtgctcgatttagacgcgatcgaagggtttggggaggaactgctcagttaggacccagacggaaccatggaagccccacgcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttagcctggtaccaacagagacctggccagcctcccaggctcctcatctttgatgcatccactagggccagtggaatcccagacaggttcagtggcagtgggtctgggacagagttcactctcagcatcaacagcgtgcgggctgaagattttgttttttattatttgttcagcagtatgataactggcctctgtggacgttcggtccaacgggacgaacggnggagtgtcaacgaaactgtggctgcaccactctgtcttctatt

SEQ ID NO: 535521 - DNA, 513 bp, Homo sapiens; identical to SEQ ID NO: 535244
  misc_feature: HIJSMM301A1G3I.17.33.C11.1.454.light.4.raw

SEQ ID NO: 535522 - DNA, 489 bp, Homo sapiens
  misc_feature: HIJSMM301A3JS3.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggtcggagggaccaccggtggaggatcaaacgaaactgtggctgcaccatctgtcttcta

SEQ ID NO: 535523 - DNA, 486 bp, Homo sapiens
  misc_feature: HIJSMM301EZH5I.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaaacgaactgtggctgcaccatctgt

SEQ ID NO: 535524 - DNA, 447 bp, Homo sapiens; identical to SEQ ID NO: 535201
  misc_feature: HIJSMM301A09EC.18.9.A09.1.454.light.4.raw

SEQ ID NO: 535525 - DNA, 476 bp, Homo sapiens
  misc_feature: HIJSMM301C7BL0.8.85.H08.1.454.light.4.raw
ctcgcgtgtccacgaccggtgctcgatttagtatcactcagtcgcggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtggggtcccatcaaggttcagtggcagtggatctgggacagatttcactctcaccatccgcagtctgcaacctgaagattttgcaatttattactgtcaagagactcacaatggaggcacttttggccaggggaccaagctggagaggaaacgaactgtggctgcaccat

SEQ ID NO: 535526 - DNA, 490 bp, Homo sapiens
  misc_feature: HIJSMM301BH68W.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgt

SEQ ID NO: 535527 - DNA, 471 bp, Homo sapiens
  misc_feature: HIJSMM301AJJ0A.13.76.G10.1.454.light.4.raw
tcacgtactacacgaccggtgctcgatttagtcactcatacaggggccgtggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcag

SEQ ID NO: 535528 - DNA, 494 bp, Homo sapiens; identical to SEQ ID NO: 534994
  misc_feature: HIJSMM301BIKRR.27.78.H01.1.454.light.4.raw

SEQ ID NO: 535529 - DNA, 504 bp, Homo sapiens
  misc_feature: HIJSMM301DJ1QX.10.88.H11.1.454.light.4.raw
catagtagtgcacgaccggtgctcgatttagcgacagcgagaacacacaaaggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaacgaactgtggctgcaccatctgtcttcatcttccgcc

SEQ ID NO: 535530 - DNA, 404 bp, Homo sapiens
  misc_feature: HIJSMM301C1ZAY.4.35.D02.1.454.light.4.raw
agcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgtcactctgttcccaccctcctcctacagtgct

SEQ ID NO: 535531 - DNA, 479 bp, Homo sapiens
  misc_feature: HIJSMM301DUFD4.41.17.B06.1.454.light.4.raw
tctatactatcacgaccggtgctcgatttagtcgatagtgaaggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttactctcaccatcaacggcctgcagtctgaagattctgcagtttattactgtcagcagtatgttgactggcctccgctcactttcggcggagggaccaaggtggagatcagacgaactgtggctgcacc

SEQ ID NO: 535532 - DNA, 484 bp, Homo sapiens; identical to SEQ ID NO: 535400
  misc_feature: HIJSMM301BV122.46.26.C04.1.454.light.4.raw

SEQ ID NO: 535533 - DNA, 484 bp, Homo sapiens; identical to SEQ ID NO: 535400
  misc_feature: HIJSMM301DN7OD.46.26.C04.1.454.light.4.raw

SEQ ID NO: 535534 - DNA, 447 bp, Homo sapiens; identical to SEQ ID NO: 535020
  misc_feature: HIJSMM301BTRZ5.18.9.A09.1.454.light.4.raw

SEQ ID NO: 535535 - DNA, 490 bp, Homo sapiens
  misc_feature: HIJSMM301CSD1Y.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggaggaccaaggtggaggtcaaacgaactgtggctgcaccatctgtcttcatt

SEQ ID NO: 535536 - DNA, 508 bp, Homo sapiens
  misc_feature: HIJSMM301EO1EE.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggtttgggacaggagtggattctcagactgtggtgacccaggagccatcgttctcagtgtcccgtggagggacagtcacactcacttgtggcttgagctctggctcagtctccactacatactcccccagctggtaccagcagaccccggaccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttggggtgttcggcggagggaccaaagctgaccgttcg

SEQ ID NO: 535537 - DNA, 489 bp, Homo sapiens; identical to SEQ ID NO: 535386
  misc_feature: HIJSMM301AYRM7.12.51.E07.1.454.light.4.raw

SEQ ID NO: 535538 - DNA, 476 bp, Homo sapiens
  misc_feature: HIJSMM301CY5WJ.4.33.C11.1.454.light.4.raw
  modified_base (429)..(429): a, c, t, g, unknown or other
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagnaatattctactactcctcgacttcgcggacggacgaaggaggagaga

SEQ ID NO: 535539 - DNA, 446 bp, Homo sapiens
  misc_feature: HIJSMM301DM761.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtcccgtgaccgattctctggctccaggtctggcaccgcagcctccctggccatcactggggctccgggctgaggatgaggctgattattactgccaggcccttgacaacagtttgggtgtttgggtgttcggcggagggaccaagctgaccgtcctaagtcagcccaaggctgccccctcggtcactctgttcccaccctcctccgtgtctgat

SEQ ID NO: 535540 - DNA, 383 bp, Homo sapiens; identical to SEQ ID NO: 447524
  misc_feature: HIJSMM301DAQQT.41.26.C04.1.454.light.4.raw

SEQ ID NO: 535541 - DNA, 496 bp, Homo sapiens
  misc_feature: HIJSMM301DME4W.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctcctcgagtgcgtct

SEQ ID NO: 535542 - DNA, 494 bp, Homo sapiens
  misc_feature: HIJSMM301AMYPK.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaatgatcaccttcggccaagggacacgactggagattaaacgaaactgtggctgcaccatctgtctt

SEQ ID NO: 535543 - DNA, 490 bp, Homo sapiens
  misc_feature: HIJSMM301ALZL9.17.67.G01.1.454.light.4.raw
cgtagactagcacgaccggtgctcgatttagagtatacatattgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtacaccatcacttgccgggcaagtcacagcattagcagctatttaaattggtatcagcagaaaccagggagagcccctaacctcctgatctatgctgcatccagtttgcagagtggggtcccatcaaggttcagtggcagtggatctggggacagatttcactctcaccatcagcagtctgcaacctgaagattttgcaacttactactgtcaacagagtctcagtacccccccggacgttcgtccggacggaccgaggtgggaaatacaaacgaactgtggctgcaccca

SEQ ID NO: 535544 - DNA, 512 bp, Homo sapiens
  misc_feature: HIJSMM301CH1H6.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccacccttcctccgtgtctgat

SEQ ID NO: 535545 - DNA, 520 bp, Homo sapiens
  misc_feature: HIJSMM301AR8NV.22.65.F10.1.454.light.4.raw
  modified_base (423)..(423): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccncccgtactcctaccgttcggaccgaacggacacgacgtaggaagtaaacttaaacgacgtggtcggtctcgacccaacctacttcgttcttcctact

SEQ ID NO: 535546 - DNA, 449 bp, Homo sapiens
  misc_feature: HIJSMM301ERBBN.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgccctccctggtcatatctggtctccagggtgaggatgaggctgattattactgccactcctatgacaacagcctgagttatttggcttgttcggcggcgggaccaagttgaccgtcctacgtcagcccaaggctcgccccctcggtcactctcgttcccaccctcctcgacacgcgag

SEQ ID NO: 535547 - DNA, 447 bp, Homo sapiens
  misc_feature: HIJSMM301BDTWL.18.73.G07.1.454.light.4.raw
tacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 535548 - DNA, 493 bp, Homo sapiens
  misc_feature: HIJSMM301EL1Q0.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcta

SEQ ID NO: 535549 - DNA, 516 bp, Homo sapiens
  misc_feature: HIJSMM301AJNKS.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaacccactgtcactctcg

SEQ ID NO: 535550 - DNA, 491 bp, Homo sapiens
  misc_feature: HIJSMM301CZUIX.10.53.E09.1.454.light.4.raw
catagtagtgcacgaccggtgctcgatttagagagagtgtgttgggtttggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaaacgaactgtgg

SEQ ID NO: 535551 - DNA, 479 bp, Homo sapiens
  misc_feature: HIJSMM301BN43I.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtggacatcagcagtgaggtggttttcggcggagggaccaagctgaccgtcctaagtcagaccccg

SEQ ID NO: 535552 - DNA, 417 bp, Homo sapiens
  misc_feature: HIJSMM301B12G5.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattacttactgcagctcatatacaagcagcagcactcaagtcttcggaactgggaccaaggtcaccgtcctaggtcagcccaaggccaaccccactgtcactctgttcccgccctcctccatactcgta

SEQ ID NO: 535553 - DNA, 491 bp, Homo sapiens; identical to SEQ ID NO: 535294
  misc_feature: HIJSMM301CUKHK.16.68.G02.1.454.light.4.raw

SEQ ID NO: 535554 - DNA, 496 bp, Homo sapiens
  misc_feature: HIJSMM301AFO6Q.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggtcggagggaccgaacgtaggagatcaaacgaactagtggctgcaccactctgtcttcta

SEQ ID NO: 535555 - DNA, 489 bp, Homo sapiens; identical to SEQ ID NO: 535139
  misc_feature: HIJSMM301B8YWU.14.55.E11.1.454.light.4.raw

SEQ ID NO: 535556 - DNA, 496 bp, Homo sapiens
  misc_feature: HIJSMM301AZLK5.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttactcggtctacaacatgataatttccctccgtggacgttcggccaagggaccaaggagcaaatcaaacgaactgtggctgcaccatctgtcttcatcttcccgccat

SEQ ID NO: 535557 - DNA, 538 bp, Homo sapiens
  misc_feature: HIJSMM301APBTJ.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgacctactcctaccgtccggaccggaacgggaccaccgtacgtaggaagttaaacgttaaaaccgtacgttgggtcggtcgtcgacccaacctacttccgttcgttccttactta

SEQ ID NO: 535558 - DNA, 495 bp, Homo sapiens
  misc_feature: HIJSMM301ANBEX.41.54.E10.1.454.light.4.raw
tctatactatcacgaccggtgctcgatttagatcgtagcagaacacacaaaggggactgatcaggactcctcagttcaccttctcacaatgaggctccctgctcagctcctggggctgctaatgctctgggtcccaggatgcagtggggatgctattctgactcagtcgccgctctccctgcccgtctcccttggacagccggcctccatttcctgcacgtctagtcaaagtctcctacatgatgatggaaacacctacctgacttggtttcaccacaggccaggccaatctccaaggcgcctaatttatcaggtttcgaagcgggactctggggtcccaggcagattcagcggcagtgggtcaggctctgctttcacgctgagaatcaacagggtggaggctgaggatgttggtgtttattactgcatgcaaggttcatattggccgtgcagttttggccaggggaccaagttggagatcaaacgaactgtggc

SEQ ID NO: 535559 - DNA, 482 bp, Homo sapiens; identical to SEQ ID NO: 535352
  misc_feature: HIJSMM301C0V7B.16.81.H04.1.454.light.4.raw

SEQ ID NO: 535560 - DNA, 486 bp, Homo sapiens; identical to SEQ ID NO: 535043
  misc_feature: HIJSMM301DM9KI.46.35.D02.1.454.light.4.raw

SEQ ID NO: 535561 - DNA, 504 bp, Homo sapiens
  misc_feature: HIJSMM301CWKS4.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcact

SEQ ID NO: 535562 - DNA, 481 bp, Homo sapiens
  misc_feature: HIJSMM301BK3S9.49.57.F02.1.454.light.4.raw
agtcgagagacacgaccggtgctcgatttagctcgatatagttgggtttggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaccagggacagcccctaaactcctgatcctcgatgcatccactttggaaacagggtcccatcaaggttcagtggaagtggctctgggacagattttactttcaccatcagcaggctgcagcctgaagatattgcaacatattactgtcaacagtatgatagtctcccgctcactttcggtcggggggaccggaacgtaggaggatcaagacgaactagt

SEQ ID NO: 535563 - DNA, 497 bp, Homo sapiens
  misc_feature: HIJSMM301BE1B0.43.38.D05.1.454.light.4.raw
tgtgagtagtcacgaccggtgctcgatttagtatctgatagttgggtttggggagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaaggaccaggtggaaatcaaacgaactgtggctgcaccatctgtcttcatcttcccgcca

SEQ ID NO: 535564 - DNA, 485 bp, Homo sapiens
  misc_feature: HIJSMM301DG1I6.7.85.H08.1.454.light.4.raw
cgtgtctctacacgaccggtgctcgatttagtatcactcagtcgcgggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtcagcccc

SEQ ID NO: 535565 - DNA, 504 bp, Homo sapiens; identical to SEQ ID NO: 535561
  misc_feature: HIJSMM301D3J1V.4.57.F02.1.454.light.4.raw

SEQ ID NO: 535566 - DNA, 493 bp, Homo sapiens
  misc_feature: HIJSMM301APTT7.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttatactgtcagcagtattatactactcctctgacgttcggccaagggaccaaggtggagatcaaacgaactgtggctgcaccat

SEQ ID NO: 535567 - DNA, 478 bp, Homo sapiens; identical to SEQ ID NO: 535129
  misc_feature: HIJSMM301AZN0X.11.11.A11.1.454.light.4.raw

SEQ ID NO: 535568 - DNA, 488 bp, Homo sapiens
  misc_feature: HIJSMM301CIP54.21.4.A04.1.454.light.4.raw
tcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaagggaccaaggtagaaatgaaacgaactgtggctgcaccat

SEQ ID NO: 535569 - DNA, 518 bp, Homo sapiens
  misc_feature: HIJSMM301CLD8O.49.10.A10.1.454.light.4.raw
  modified_base (507)..(507): a, c, t, g, unknown or other
agtcgagagacacgaccggtgctcgatttagcgtcgatctcaggggctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgcccncctctctctcg

SEQ ID NO: 535570 - DNA, 481 bp, Homo sapiens
  misc_feature: HIJSMM301CEII4.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaacgaactgtggctgcaccat

SEQ ID NO: 535571 - DNA, 512 bp, Homo sapiens
  misc_feature: HIJSMM301COO32.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaaccccactgtcactctgttcccgccctcctcga

SEQ ID NO: 535572 - DNA, 494 bp, Homo sapiens
  misc_feature: HIJSMM301CGL63.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcgagggaccaagctgaccgtcctgggtcagcccaaggctgccccctcggtcactc

SEQ ID NO: 535573 - DNA, 492 bp, Homo sapiens
  misc_feature: HIJSMM301EOFKQ.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagttattccttttactttcggccctgggaccaaagtggatatcaaacgaactgtggctgcaccat

SEQ ID NO: 535574 - DNA, 502 bp, Homo sapiens
  misc_feature: HIJSMM301C4BIR.49.53.E09.1.454.light.4.raw
agtcgagagacacgaccggtgctcgatttagagagagtgtgttgggtttgggggtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgttttcggtcggagggaccaggctgaccgtcctgggtcagcccaaggctgcccctcggtcactctcg

SEQ ID NO: 535575 - DNA, 511 bp, Homo sapiens
  misc_feature: HIJSMM301COVL9.5.58.F03.1.454.light.4.raw
atcagacacgcacgaccggtgctcgatttagtctgatcgagaagggaaaggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactgtcactctcg

SEQ ID NO: 535576 - DNA, 496 bp, Homo sapiens; identical to SEQ ID NO: 535109
  misc_feature: HIJSMM301BX50Z.16.78.H01.1.454.light.4.raw

SEQ ID NO: 535577 - DNA, 497 bp, Homo sapiens
  misc_feature: HIJSMM301C297O.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaagtacaaacgaactgtggctgcaccatctgtcttcatt

SEQ ID NO: 535578 - DNA, 504 bp, Homo sapiens; identical to SEQ ID NO: 535128
  misc_feature: HIJSMM301BLXR8.19.85.H08.1.454.light.4.raw

SEQ ID NO: 535579 - DNA, 497 bp, Homo sapiens
  misc_feature: HIJSMM301AJ5JB.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatcaacgaactgtggctgcacc

SEQ ID NO: 535580 - DNA, 494 bp, Homo sapiens; identical to SEQ ID NO: 535184
  misc_feature: HIJSMM301DW4AM.16.71.G05.1.454.light.4.raw

SEQ ID NO: 535581 - DNA, 520 bp, Homo sapiens
  misc_feature: HIJSMM301AHFLR.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccacggaccgaacggtaggaaggtacgtaaacgaaactagtaggcgtgcaccactctgtcttctactcttcccgtcccact

SEQ ID NO: 535582 - DNA, 508 bp, Homo sapiens
  misc_feature: HIJSMM301CT4JT.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcattttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggaggaccaagctgaccgtcctaggtcagcccaaggctgccccctcggtcactctgttcccg

SEQ ID NO: 535583 - DNA, 487 bp, Homo sapiens
  misc_feature: HIJSMM301AKIHV.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaaacgaactgtggctgcaccatctgtt

SEQ ID NO: 535584 - DNA, 472 bp, Homo sapiens
  misc_feature: HIJSMM301DRR6E.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaaggtggaaatcaaacgaactgtgg

SEQ ID NO: 535585 - DNA, 483 bp, Homo sapiens; identical to SEQ ID NO: 535013
  misc_feature: HIJSMM301CXHGE.11.76.G10.1.454.light.4.raw

SEQ ID NO: 535586 - DNA, 479 bp, Homo sapiens
  misc_feature: HIJSMM301A6QMR.13.34.D01.1.454.light.4.raw
tcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacgactggagattaaaggaa

SEQ ID NO: 535587 - DNA, 488 bp, Homo sapiens
  misc_feature: HIJSMM301ECRYP.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggtccgagggaccaagctggagatcaggcgaacg

SEQ ID NO: 535588 - DNA, 496 bp, Homo sapiens; identical to SEQ ID NO: 535109
  misc_feature: HIJSMM301ARM36.16.78.H01.1.454.light.4.raw

SEQ ID NO: 535589 - DNA, 489 bp, Homo sapiens; identical to SEQ ID NO: 535139
  misc_feature: HIJSMM301D9YVX.14.55.E11.1.454.light.4.raw

SEQ ID NO: 535590 - DNA, 492 bp, Homo sapiens
  misc_feature: HIJSMM301DISPP.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtgctgcaccatctgtcttcatt

SEQ ID NO: 535591 - DNA, 444 bp, Homo sapiens; identical to SEQ ID NO: 535027
  misc_feature: HIJSMM301ETI8U.8.73.G07.1.454.light.4.raw

SEQ ID NO: 535592 - DNA, 447 bp, Homo sapiens; identical to SEQ ID NO: 535201
  misc_feature: HIJSMM301EVYOB.18.9.A09.1.454.light.4.raw

SEQ ID NO: 535593 - DNA, 441 bp, Homo sapiens; identical to SEQ ID NO: 535074
  misc_feature: HIJSMM301BM7MV.11.3.A03.1.454.light.4.raw

SEQ ID NO: 535594 - DNA, 444 bp, Homo sapiens
  misc_feature: HIJSMM301CAWRH.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccaccctcctcagacgtatca

SEQ ID NO: 535595 - DNA, 453 bp, Homo sapiens
  misc_feature: HIJSMM301CJK2J.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctcacgagagta

SEQ ID NO: 535596 - DNA, 495 bp, Homo sapiens
  misc_feature: HIJSMM301AM7EB.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtctt

SEQ ID NO: 535597 - DNA, 496 bp, Homo sapiens
  misc_feature: HIJSMM301CXCCG.22.20.B09.1.454.light.4.raw
acatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccgggtcagactatctgctcaccatcggcggtctggaacctgaagattctgcactatattactgtcagctttatgttaattcacctccgtcgtacatctttggccaggggaccaagctggagatcaaacgaactgtggctgcaccatctgtcttcat

SEQ ID NO: 535598 - DNA, 487 bp, Homo sapiens
  misc_feature: HIJSMM301BGSHV.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatcccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaacgaactgtggctgcaccat

SEQ ID NO: 535599 - DNA, 511 bp, Homo sapiens
  misc_feature: HIJSMM301AZMVK.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctcgggaccgaaaattagagatcaaacgaaactgtggctgcaccatctgtcttctatcttcccgccat

SEQ ID NO: 535600 - DNA, 537 bp, Homo sapiens
  misc_feature: HIJSMM301AT3GF.49.11.A11.1.454.light.4.raw
  modified_base (523)..(523): a, c, t, g, unknown or other
agtcgagagacacgaccggtgctcgatttagctacgactgcaggggctgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtggggaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaagacggggagtgaggccgactattacttgtcaggtgtgggagtagtggtagtggtgtcgtcttcggagctgggaccgacgggtcgaccgtcccgtaggtcagccccaacggcccaaaccccctacctacgtctcctctcgttccgtcccccncctccttctctccg

SEQ ID NO: 535601 - DNA, 486 bp, Homo sapiens; identical to SEQ ID NO: 535043
  misc_feature: HIJSMM301DLGV4.46.35.D02.1.454.light.4.raw

SEQ ID NO: 535602 - DNA, 486 bp, Homo sapiens; identical to SEQ ID NO: 535043
  misc_feature: HIJSMM301AHZSX.46.35.D02.1.454.light.4.raw

SEQ ID NO: 535603 - DNA, 501 bp, Homo sapiens
  misc_feature: HIJSMM301BINMQ.21.38.D05.1.454.light.4.raw
tcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttccccg

SEQ ID NO: 535604 - DNA, 491 bp, Homo sapiens
  misc_feature: HIJSMM301BGSBL.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcactttcggtcggagggaccgaacggcggagatcagacgaactgtggctgcaccatctgtcttcta

SEQ ID NO: 535605 - DNA, 477 bp, Homo sapiens
  misc_feature: HIJSMM301ALG7E.5.28.C06.1.454.light.4.raw
atcagacacgcacgaccggtgctcgatttagagctcacgtattgggtttgggggcaggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccgaaggtggagatcgaacgaactgtgg

SEQ ID NO: 535606 - DNA, 485 bp, Homo sapiens
  misc_feature: HIJSMM301CJLO2.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccat

SEQ ID NO: 535607 - DNA, 494 bp, Homo sapiens; identical to SEQ ID NO: 534994
  misc_feature: HIJSMM301BHSHK.27.78.H01.1.454.light.4.raw

SEQ ID NO: 535608 - DNA, 452 bp, Homo sapiens; identical to SEQ ID NO: 535227
  misc_feature: HIJSMM301BCXST.19.86.H09.1.454.light.4.raw

SEQ ID NO: 535609 - DNA, 485 bp, Homo sapiens
  misc_feature: HIJSMM301CH4A3.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgcagtctattactgtcagcagtatggtcacgtcccaagaacttttggccaggggaccaagctggagatcaaacgaactgtggctgcaccat

SEQ ID NO: 535610 - DNA, 490 bp, Homo sapiens
  misc_feature: HIJSMM301EEVEW.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttacactgtcaacagacttacagtgcccccccgatcaccttcggccaacgggacacgactggagattaaacgaactgtggctgcaccatctgtcttcat

SEQ ID NO: 535611 - DNA, 494 bp, Homo sapiens
  misc_feature: HIJSMM301B408P.3.14.B03.1.454.light.4.raw
agacgcactccacgaccggtgctcgatttagtgtgagtagtcccgcggaactactcacacccatggcctggaccgttctcctcctcggcctcctctctcactgcacaggctctgtgacctcctatgtgctgactcagccaccctcggtgtcagtggccccaggaaagacggccaggattacctgtgggggaaacaaaattggagataaaagtgtgcactggtaccagcagaagccaggccaggcccctgtgctggtcatccattctgatagcgaccgcccctcagggatccctgagcgattctctggctccaactctgcgaacacggccaccctgaccatcagcagggtcgaagccggggatgaggccgactattcttgtcaggtgtgggatagtagtactgtgatattcggcggagggaccaagctgaccgtcctaggtcagcccaaggctgccccctcggtcactctgttcccgccctcctcgagtgcgtct

SEQ ID NO: 535612 - DNA, 496 bp, Homo sapiens
  misc_feature: HIJSMM301D73BC.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgactttggccagggggccaagctggagatcagacgaactgtggctgcaccatctgtcttcatcttccccg

SEQ ID NO: 535613 - DNA, 495 bp, Homo sapiens
  misc_feature: HIJSMM301BX9FN.27.78.H01.1.454.light.4.raw
  modified_base (454)..(454): a, c, t, g, unknown or other
agcgtcgtctcacgaccggtgctcgatttagtgtgagtagtttgggtttggggatgagcaaaactagacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacncgactggagattaaacgaactgtggctgcaccatctgtctt

SEQ ID NO: 535614 - DNA, 493 bp, Homo sapiens
  misc_feature: HIJSMM301BJH56.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaggaactgtggctgcaccatctgtcttcatcttccccg

SEQ ID NO: 535615 - DNA, 512 bp, Homo sapiens
  misc_feature: HIJSMM301AFLW6.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctcgggaccgaaagtaggatatcaaacgaactagtggctgcaccatctgtcttcta

SEQ ID NO: 535616 - DNA, 478 bp, Homo sapiens
  misc_feature: HIJSMM301COVGO.40.22.B11.1.454.light.4.raw
tctagcgactcacgaccggtgctcgatttagacgacagctcaggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggccaaggtggaaatcaagcgaa

SEQ ID NO: 535617 - DNA, 508 bp, Homo sapiens
  misc_feature: HIJSMM301BH1GO.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccacggacgaacggtaggaagtacaagacgactagtggctgcaccactctgtcttctactcttcccgt

SEQ ID NO: 535618 - DNA, 444 bp, Homo sapiens; identical to SEQ ID NO: 535411
  misc_feature: HIJSMM301AG3FP.8.73.G07.1.454.light.4.raw

SEQ ID NO: 535619 - DNA, 502 bp, Homo sapiens
  misc_feature: HIJSMM301BFNSB.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaaggacgacactggagattaaacg

SEQ ID NO: 535620 - DNA, 489 bp, Homo sapiens
  misc_feature: HIJSMM301DHK2P.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaacgaactgtgg

SEQ ID NO: 535621 - DNA, 497 bp, Homo sapiens
  misc_feature: HIJSMM301AMXJ3.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgacggcggacggatcagacgaactagtggcgtcgcaccactctcgtcttcta

SEQ ID NO: 535622 - DNA, 494 bp, Homo sapiens; identical to SEQ ID NO: 535276
  misc_feature: HIJSMM301ANL17.16.6.A06.1.454.light.4.raw

SEQ ID NO: 535623 - DNA, 502 bp, Homo sapiens
  misc_feature: HIJSMM301C8FKL.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaggaccgaaggtggaatacaaacgaactagtggctgcaccatctgtcttctatcttccccg

SEQ ID NO: 535624 - DNA, 509 bp, Homo sapiens
  misc_feature: HIJSMM301ASNXN.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctcgtttggttcatctataaagataggaatcggccctcagacatccctgagcgattctctggctccagctctggaaacacagccactctgaccatcaccgggacccagactatggatgaagctgactattactgtcaggcgtgggacgagcggcactgtggttttcggtcggagggaccgaagctgaccgtcctcggtcgagcccaacggctgccccctccggtcactctcgttcccaccct

SEQ ID NO: 535625 - DNA, 493 bp, Homo sapiens
  misc_feature: HIJSMM301CMKIT.52.33.C11.1.454.light.4.raw
cgcagtacgacacgaccggtgctcgatttagagtgagctcgttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccact

SEQ ID NO: 535626 - DNA, 475 bp, Homo sapiens
  misc_feature: HIJSMM301BK9YD.7.81.H04.1.454.light.4.raw
  modified_base (467)..(467): a, c, t, g, unknown or other
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcgccctgggactgaagtgcatatgaagagaactntggctgca

SEQ ID NO: 535627 - DNA, 491 bp, Homo sapiens
  misc_feature: HIJSMM301ASQJ4.40.77.G11.1.454.light.4.raw
tctagcgactcacgaccggtgctcgatttagctagtcactcaagggaaaggggaggtcagacccacgtcaggacacagcatggacatgagggtccccgcctcagctcctggggcgtcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaagcccctaagctcctgatctataaggcatctagtttagaaagtggggtcccatccaggttcagcggcagtggatctgggacagaattcgctctcaaccatcagcagcctgcagcctgatgattttgcaacttattactgccaacactatgatagttattctccgtacacctttggtccaggggaccaaggtggagatcaagcgaactgtggctgcacca

SEQ ID NO: 535628 - DNA, 481 bp, Homo sapiens
  misc_feature: HIJSMM301BPLM2.14.11.A11.1.454.light.4.raw
cgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtcccatcaaggttcagcggcagtggatctggcacagatttcactctcaccatcagcagcctgcagcctgaagattttgcaacttattactgtctacaagattacaattaccctcgaacgttcggccaagggaccaaggtggaagtcaaacgaactgtggctgcaccat

SEQ ID NO: 535629 - DNA, 494 bp, Homo sapiens
  misc_feature: HIJSMM301D2TLY.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtcact

SEQ ID NO: 535630 - DNA, 480 bp, Homo sapiens
  misc_feature: HIJSMM301B2Z4B.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagaccccg

SEQ ID NO: 535631 - DNA, 443 bp, Homo sapiens
  misc_feature: HIJSMM301ECTIL.2.76.G10.1.454.light.4.raw
acgctcgacacacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccgccctcctctgtcgagcgt

SEQ ID NO: 535632 - DNA, 490 bp, Homo sapiens; identical to SEQ ID NO: 535234
  misc_feature: HIJSMM301BUCFC.17.21.B10.1.454.light.4.raw

SEQ ID NO: 535633 - DNA, 490 bp, Homo sapiens
  misc_feature: HIJSMM301AGKFH.40.37.D04.1.454.light.4.raw
tctagcgactcacgaccggtgctcgatttagtagcatactgttgggtttggggtgatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggtccctcggaccgacgagtggagtgtcaacgaacta

SEQ ID NO: 535634 - DNA, 489 bp, Homo sapiens
  misc_feature: HIJSMM301BOSJ6.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggagggaccaaggcggagatcagacgaactgtggctgcaccatctgtcttct

SEQ ID NO: 535635 - DNA, 488 bp, Homo sapiens; identical to SEQ ID NO: 535081
  misc_feature: HIJSMM301CRP13.26.23.C01.1.454.light.4.raw

SEQ ID NO: 535636 - DNA, 444 bp, Homo sapiens
  misc_feature: HIJSMM301ASD0G.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcagggtcccgtgaccgattctctggttccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccaccctcctcagacgtatca

SEQ ID NO: 535637 - DNA, 491 bp, Homo sapiens
  misc_feature: HIJSMM301DDIRB.49.28.C06.1.454.light.4.raw
agtcgagagacacgaccggtgctcgatttagagctcacgtattgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccagggaccaagctggaaatcagacgaactgtggctgcaccat

SEQ ID NO: 535638 - DNA, 489 bp, Homo sapiens
  misc_feature: HIJSMM301BHHLG.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactagtggctgcaccatctgtt

SEQ ID NO: 535639 - DNA, 494 bp, Homo sapiens; identical to SEQ ID NO: 534994
  misc_feature: HIJSMM301AOT5J.27.78.H01.1.454.light.4.raw

SEQ ID NO: 535640 - DNA, 467 bp, Homo sapiens
  misc_feature: HIJSMM301D0ACG.11.70.G04.1.454.light.4.raw
cgagagataccacgaccggtgctcgatttagtgtagtgtgaagggaaaggggcgagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgctatccactctgcaatcaggggtcccatctcgattcagtggcagtggatctgggacagatttcactctcaccatcagcagcctgcagcctgaagatgttgcaacttattactgtcaaaagaatagcgctgcccccgctcagtttcggcggagggaccaaggtggagata

SEQ ID NO: 535641 - DNA, 507 bp, Homo sapiens
  misc_feature: HIJSMM301CG8RF.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactgtggctgcaccatctgtcttcatcttcccgcc

SEQ ID NO: 535642 - DNA, 493 bp, Homo sapiens
  misc_feature: HIJSMM301B1AHF.9.1.A01.1.454.light.4.raw
  modified_base (441)..(441): a, c, t, g, unknown or other
tgatacgtctcacgaccggtgctcgatttagacgtctcatcaggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacncgactggagattaaaggaactgtggctgcaccatctgtcttcatcttccccg

SEQ ID NO: 535643 - DNA, 481 bp, Homo sapiens
  misc_feature: HIJSMM301AYLF2.11.73.G07.1.454.light.4.raw
cgagagataccacgaccggtgctcgatttagctctacgctcagggggcgaggagtcagtcccaacccaggacacagcatggacatgggggtcccgtcgctcagctcctggggcgtcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctcgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctcgggaccagagtggacatgaaacgaactgtggctgca

SEQ ID NO: 535644 - DNA, 478 bp, Homo sapiens; identical to SEQ ID NO: 535129
  misc_feature: HIJSMM301BD5VL.11.11.A11.1.454.light.4.raw

SEQ ID NO: 535645 - DNA, 445 bp, Homo sapiens
  misc_feature: HIJSMM301ARZYC.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctccggtcactctgttcccaccctcctccgtgtctgat

SEQ ID NO: 535646 - DNA, 494 bp, Homo sapiens; identical to SEQ ID NO: 534994
  misc_feature: HIJSMM301AL5TA.27.78.H01.1.454.light.4.raw

SEQ ID NO: 535647 - DNA, 481 bp, Homo sapiens
  misc_feature: HIJSMM301A7S01.41.57.F02.1.454.light.4.raw
tctatactatcacgaccggtgctcgatttagctcgatatagttgggtttggggctccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggagtctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcct

SEQ ID NO: 535648 - DNA, 485 bp, Homo sapiens
  misc_feature: HIJSMM301AEQDI.17.36.D03.1.454.light.4.raw
cgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagagtgttagcagctacttagcctggtaccaacagaaacctggccagtctcccaggctcctcatctatgatgcatccaacagggccactggcatcccagccaggttcagtggcagtgggtctgggacagacttcattctcaccatcagcagcctagagcctgaagattttgcagtttattactgtcagcagcgtagcaactggctcatcaccttcggccaagggacacgactggagatgaaacgaactgtggctgcacc

SEQ ID NO: 535649 - DNA, 508 bp, Homo sapiens
  misc_feature: HIJSMM301BU904.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaacccca

SEQ ID NO: 535650 - DNA, 453 bp, Homo sapiens
  misc_feature: HIJSMM301COAHR.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccgccctcctccacgagagta

SEQ ID NO: 535651 - DNA, 488 bp, Homo sapiens
  misc_feature: HIJSMM301D6QB6.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtcttccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgt

SEQ ID NO: 535652 - DNA, 485 bp, Homo sapiens
  misc_feature: HIJSMM301A8BNX.19.71.G05.1.454.light.4.raw
tactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 535653 - DNA, 485 bp, Homo sapiens
  misc_feature: HIJSMM301BS5V1.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggaccaaagtggatatcaaacgaactgtggctgcaccatctgt

SEQ ID NO: 535654 - DNA, 492 bp, Homo sapiens
  misc_feature: HIJSMM301A8M3O.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaaggacggagatcagacgaactgtggcgtgcaccatctgtcttcta

SEQ ID NO: 535655 - DNA, 470 bp, Homo sapiens
  misc_feature: HIJSMM301DJLSP.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcgggggaccaaggtggacatcaaagaa

SEQ ID NO: 535656 - DNA, 486 bp, Homo sapiens
  misc_feature: HIJSMM301CCKWN.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgcaacaatatgatatttattctccagcgttcggccagggaccaaggtggaagtcaagcgaactgtggctgcaccatctgt

SEQ ID NO: 535657 - DNA, 493 bp, Homo sapiens
  misc_feature: HIJSMM301EHZ91.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgt

SEQ ID NO: 535658 - DNA, 510 bp, Homo sapiens
  misc_feature: HIJSMM301CKBL4.14.55.E11.1.454.light.4.raw
  modified_base (462)..(462): a, c, t, g, unknown or other
  modified_base (498)..(498): a, c, t, g, unknown or other
cgtctagtaccacgaccggtgctcgatttagcactcgcacgttgggtttgggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtaccccctcctctcgttcggacgggaacggaacgacgggacgganactacgacgaacgtacgtggtcgtcgcaccaacctnttcgttcttctt

SEQ ID NO: 535659 - DNA, 509 bp, Homo sapiens
  misc_feature: HIJSMM301D011V.48.14.B03.1.454.light.4.raw
agtatacatacacgaccggtgctcgatttagtgtgagtagttccgcgggactgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtcggaaataaacgaaactgtggctgcaccatctgtcttca

SEQ ID NO: 535660 - DNA, 496 bp, Homo sapiens
  misc_feature: HIJSMM301BAXMM.43.25.C03.1.454.light.4.raw
tgtgagtagtcacgaccggtgctcgatttagtagtgtagatttgggtttgggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttggggtttattactgcatgcaaggtacacactggcccgtcaccttcggccaagggacacgactggagattaaacgaactgtggctgcacc

SEQ ID NO: 535661 - DNA, 493 bp, Homo sapiens
  misc_feature: HIJSMM301EDN6M.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaagggaccaaggtaggaagtcaaacgaactagtggctgcaccatctgtctt

SEQ ID NO: 535662 - DNA, 502 bp, Homo sapiens
  misc_feature: HIJSMM301BLZ2K.48.34.D01.1.454.light.4.raw
agtatacatacacgaccggtgctcgatttagatcgtctgtgttgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 535663 - DNA, 505 bp, Homo sapiens; identical to SEQ ID NO: 535503
  misc_feature: HIJSMM301CS4EU.8.28.C06.1.454.light.4.raw

SEQ ID NO: 535664 - DNA, 497 bp, Homo sapiens
  misc_feature: HIJSMM301A9G01.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacca

SEQ ID NO: 535665 - DNA, 479 bp, Homo sapiens
  misc_feature: HIJSMM301DQGX6.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttaccctcgtattttcggccctgggaccacagtagatatcaaacgaactgtggctgcacc

SEQ ID NO: 535666 - DNA, 489 bp, Homo sapiens; identical to SEQ ID NO: 535139
  misc_feature: HIJSMM301B75A0.14.55.E11.1.454.light.4.raw

SEQ ID NO: 535667 - DNA, 440 bp, Homo sapiens
  misc_feature: HIJSMM301DVVGL.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgcccctcggtcactctgttcccgccctcctcatagtataga

SEQ ID NO: 535668 - DNA, 488 bp, Homo sapiens; identical to SEQ ID NO: 535125
  misc_feature: HIJSMM301A8O8J.17.25.C03.1.454.light.4.raw

SEQ ID NO: 535669 - DNA, 465 bp, Homo sapiens; identical to SEQ ID NO: 535060
  misc_feature: HIJSMM301AGO8G.3.20.B09.1.454.light.4.raw

SEQ ID NO: 535670 - DNA, 509 bp, Homo sapiens
  misc_feature: HIJSMM301C8WU2.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctgccccctcggtcactctgtt

SEQ ID NO: 535671 - DNA, 444 bp, Homo sapiens
  misc_feature: HIJSMM301CAVOV.10.27.C05.1.454.light.4.raw
catagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgccccctcggtcactctgttcccaccctcctccactactatg

SEQ ID NO: 535672 - DNA, 486 bp, Homo sapiens
  misc_feature: HIJSMM301ATFFR.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatattcgtggacgtgtccaaggaccgaagtaggagtatacagacgaac

SEQ ID NO: 535673 - DNA, 492 bp, Homo sapiens
  misc_feature: HIJSMM301CRO7E.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagttattactgtcaacagcgtaccacaggattcactttcggccctgggaccagagtggatatcaaacgaactgtggctgcaccatctgtcttcatcttcccg

SEQ ID NO: 535674 - DNA, 505 bp, Homo sapiens
  misc_feature: HIJSMM301BUTYF.4.71.G05.1.454.light.4.raw
agcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataattctggtgttcggcggagggaccaactgaccgtctaggtcagcccaaggctcgccccctcggtcactctcgttccccg

SEQ ID NO: 535675 - DNA, 483 bp, Homo sapiens
  misc_feature: HIJSMM301DKK3P.41.35.D02.1.454.light.4.raw
tctatactatcacgaccggtgctcgatttagcacacgatagttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcacca

SEQ ID NO: 535676 - DNA, 486 bp, Homo sapiens; identical to SEQ ID NO: 535523
  misc_feature: HIJSMM301ALQLX.22.73.G07.1.454.light.4.raw

SEQ ID NO: 535677 - DNA, 481 bp, Homo sapiens
  misc_feature: HIJSMM301C1E5Z.5.39.D06.1.454.light.4.raw
atcagacacgcacgaccggtgctcgatttagtgacatctcgcagttctttggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaactgtggctgcaccat

SEQ ID NO: 535678 - DNA, 483 bp, Homo sapiens
  misc_feature: HIJSMM301EJI9K.5.6.A06.1.454.light.4.raw
atcagacacgcacgaccggtgctcgatttagatctactgacagggggagtcagacccagtcaggacacagcatggacatgagggtccccgctcagctcctggggctcctgctgctctggttcccaggttccagatgcgacatccagatgacccagtctccatcttccgtgtctgcttctataggagacagagtcaccatcacttgtcgggcgagtcagggtcttaacaactacttagcctggtatcagcagaagccagggaaagcccctaagctcctgatctatgctacatccagtttgcaaagtgggtcccttcaaggttcagcggcagtggaactggtatagatttcactctcaccatcaccagcctgcagcctgaagatcttgcaacttactattgtcagcaggctaggaggacgccgtggacgttcggccaagggaccaaggtggaaatcaaacgaactgtggctgcacatctgtcttc

SEQ ID NO: 535679 - DNA, 444 bp, Homo sapiens; identical to SEQ ID NO: 535192
  misc_feature: HIJSMM301BCGBO.5.9.A09.1.454.light.4.raw

SEQ ID NO: 535680 - DNA, 494 bp, Homo sapiens
  misc_feature: HIJSMM301A4B1J.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatct

SEQ ID NO: 535681 - DNA, 495 bp, Homo sapiens; identical to SEQ ID NO: 535007
  misc_feature: HIJSMM301BTXCR.22.5.A05.1.454.light.4.raw

SEQ ID NO: 535682 - DNA, 518 bp, Homo sapiens
  misc_feature: HIJSMM301ALAEX.5.27.C05.1.454.light.4.raw
  modified_base (505)..(505): a, c, t, g, unknown or other
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactcgttcccnccctcctccgtgt

SEQ ID NO: 535683 - DNA, 508 bp, Homo sapiens
  misc_feature: HIJSMM301ANBMX.40.9.A09.1.454.light.4.raw
tctagcgactcacgaccggtgctcgatttagcgagacgcgcaggggacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttgcggagggaccgaaggtggaggtcaaacgaactagtggcgtgcaccatctgtcttcatcttccccg

SEQ ID NO: 535684 - DNA, 494 bp, Homo sapiens
  misc_feature: HIJSMM301EW4K6.49.12.B01.1.454.light.4.raw
agtcgagagacacgaccggtgctcgatttagtagtgtagattccgcgggcacgaccggtgctcgatttagtagtgtagattcgcgggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttctaccatcatcaacctgcagcctgaggatattgcaacatattactgtcaacaatatagataatactaccactcacttcggtcggaggaccgac

SEQ ID NO: 535685 - DNA, 510 bp, Homo sapiens
  misc_feature: HIJSMM301EL0EJ.7.87.H10.1.454.light.4.raw
cgtgtctctacacgaccggtgctcgatttagcagtactgcgttgggtttggggagctgctcagttaggacccacgagggaaccatggaaaccccacgcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttgccacggacgaacgtaggagtacaacgaactagtggcgtgcaccactctgtcttctatcttcccgtcccact

SEQ ID NO: 535686 - DNA, 520 bp, Homo sapiens
  misc_feature: HIJSMM301AU7Z7.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccgccctcct

SEQ ID NO: 535687 - DNA, 504 bp, Homo sapiens
  misc_feature: HIJSMM301EL8T7.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcatttatttctgtcagcagtctgaagactggccgttcactttcggcggagggaccaaggtggacctcaaacgaactgtggctgcaccatctgtcttcatcttcccgcc

SEQ ID NO: 535688 - DNA, 485 bp, Homo sapiens
  misc_feature: HIJSMM301B0HVK.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggccctgggactaaggtggagatcagacgaactgtggctgcaccatctgtcttcta

SEQ ID NO: 535689 - DNA, 514 bp, Homo sapiens
  misc_feature: HIJSMM301AOKJQ.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggtttttcggcggagggaccaagctgaccgtcctaggtcagcccaaggctgccccctcggtcactctgttcccg

SEQ ID NO: 535690 - DNA, 494 bp, Homo sapiens; identical to SEQ ID NO: 534994
  misc_feature: HIJSMM301CVGYB.27.78.H01.1.454.light.4.raw

SEQ ID NO: 535691 - DNA, 489 bp, Homo sapiens
  misc_feature: HIJSMM301APFL6.12.31.C09.1.454.light.4.raw
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagagttaccgcgctccccatcactttcggccaagggacacgaccgcagattggacgaactgtggctgcacc

SEQ ID NO: 535692 - DNA, 497 bp, Homo sapiens
  misc_feature: HIJSMM301BP626.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaagtcaaacgaaactgtggctgcaccatctgtcttcatt

SEQ ID NO: 535693 - DNA, 421 bp, Homo sapiens
  misc_feature: HIJSMM301D71HJ.41.14.B03.1.454.light.4.raw
tctatactatcacgaccggtgctcgatttagtgtgagtagttccgcgggcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatatataga

SEQ ID NO: 535694 - DNA, 480 bp, Homo sapiens; identical to SEQ ID NO: 535291
  misc_feature: HIJSMM301D9R5X.22.59.F04.1.454.light.4.raw

SEQ ID NO: 535695 - DNA, 500 bp, Homo sapiens
  misc_feature: HIJSMM301AFHT9.11.71.G05.1.454.light.4.raw
cgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggccaccccagccaggttcagtggcagtgggtctgggacagacttcactctcaccatcagcagcctagagcctgaggtattttgcagtttattactgtcagcagcgtatcgactggatcaccttcggccaagggacacgactggaaattaaacgaactgtggctgcaccatctgtcttcatcttccccg

SEQ ID NO: 535696 - DNA, 500 bp, Homo sapiens; identical to SEQ ID NO: 535310
  misc_feature: HIJSMM301CP0J3.47.66.F11.1.454.light.4.raw

SEQ ID NO: 535697 - DNA, 482 bp, Homo sapiens
  misc_feature: HIJSMM301CTOU0.13.8.A08.1.454.light.4.raw
tcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccaggggaccaggctggagatcaaacgaactgtggctgcaccatctgtt

SEQ ID NO: 535698 - DNA, 499 bp, Homo sapiens
  misc_feature: HIJSMM301AZRX9.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcat

SEQ ID NO: 535699 - DNA, 492 bp, Homo sapiens
  misc_feature: HIJSMM301DYU4G.51.6.A06.1.454.light.4.raw
cgatcgtatacacgaccggtgctcgatttagatctactgacagggggggaggcctagctgtgctgtgggtccgaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctcgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaaggtcaccgtcctaggtcagcccaac

SEQ ID NO: 535700 - DNA, 486 bp, Homo sapiens; identical to SEQ ID NO: 535043
  misc_feature: HIJSMM301CPASV.46.35.D02.1.454.light.4.raw

SEQ ID NO: 535701 - DNA, 504 bp, Homo sapiens
  misc_feature: HIJSMM301CLZSQ.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaacgcccccaaactcatgatttatgagggcactaagcggccctcaggggtttctgatcgcttctctggctccaagtctggcaacacggcctccctgacaatctctgggctccaggctgaggacgaggctgattattactgcaactcacttacaacgaccgacacttgcgtattcggcggcgggaccaagctgaccgtctaggtcagcccaaggctcgcccctcggt

SEQ ID NO: 535702 - DNA, 491 bp, Homo sapiens
  misc_feature: HIJSMM301A3VN7.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcggtcggaggaccgaacgacggagatcagacgaactgtggcgtgcaccactctgtcttcta

SEQ ID NO: 535703 - DNA, 509 bp, Homo sapiens
  misc_feature: HIJSMM301DG7MD.17.2.A02.1.454.light.4.raw
cgtagactagcacgaccggtgctcgatttagactcatctacaggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccactgtcactctgttcccgccct

SEQ ID NO: 535704 - DNA, 487 bp, Homo sapiens
  misc_feature: HIJSMM301B2DR5.52.83.H06.1.454.light.4.raw
cgcagtacgacacgaccggtgctcgatttagatcacgtgcgtcgcgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcggcggagggaccaaggtcgagatcaaacgaactgtggctgcaccatctgtctt

SEQ ID NO: 535705 - DNA, 454 bp, Homo sapiens
  misc_feature: HIJSMM301C91KX.5.86.H09.1.454.light.4.raw
atcagacacgcacgaccggtgctcgatttagtgctatagacttgggtttgggggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtcactctgttcccaccctcctccgtgtctgat

SEQ ID NO: 535706 - DNA, 485 bp, Homo sapiens
  misc_feature: HIJSMM301BOF12.17.21.B10.1.454.light.4.raw
cgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaactggatatcagacgaactgtgg

SEQ ID NO: 535707 - DNA, 498 bp, Homo sapiens
  misc_feature: HIJSMM301CZJ66.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggtccaaggaccgaaggtaggaggatcaaacgaactagtggctgcaccat

SEQ ID NO: 535708 - DNA, 461 bp, Homo sapiens
  misc_feature: HIJSMM301EBK5X.11.86.H09.1.454.light.4.raw
cgagagataccacgaccggtgctcgatttagtgctatagacttgggtttggggccgttcctgggcccagtctgtgctgactcagccaccctcagcgtctgggacccccggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccgaagctgaccgtcctaggtcagcccaacggctgccccctccggtcactctgttcccaccctcctcgtatctctcg

SEQ ID NO: 535709 - DNA, 504 bp, Homo sapiens
  misc_feature: HIJSMM301D88T3.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatgcgggggtgttcggcggagggaccaagctgaccgtcctaagtcagcccaaggctgccccctcggtcact

SEQ ID NO: 535710 - DNA, 484 bp, Homo sapiens
  misc_feature: HIJSMM301A1A0W.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaaacagagttttcactaccccctctcactttcggcggggggaccaagtggagatcaaacgaactgtggctg

SEQ ID NO: 535711 - DNA, 519 bp, Homo sapiens
  misc_feature: HIJSMM301BBFWX.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcaagagtacttacttacctacagtgatcctaccgttccggaccgaacggacgaccgtacgtaggagtaattaaaaccg

SEQ ID NO: 535712 - DNA, 495 bp, Homo sapiens
  misc_feature: HIJSMM301AQ2QI.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaaactgtggctgcaccatctgtctt

SEQ ID NO: 535713 - DNA, 494 bp, Homo sapiens
  misc_feature: HIJSMM301B57KW.49.6.A06.1.454.light.4.raw
agtcgagagacacgaccggtgctcgatttagatctactgacagggggctggggtctcaggaggcagcgctctcaggacgtcaccaccatggcctgggctctgctcctcctcaccctcctcactcagggcacagggtcctgggcccagtctgccctgactcagccgccctccgcgtccgggtctcctggacagtctgtcaccatctcctgcactggaaccagcagtgacgttggtgattataactatgtctcctggtaccaacagtacccaggcaaagcccccagactcatgatttatgcggtcagtaagcggccctcaggggtccctgatcgcttctctggctccaagtctggcaacacggcctccctgaccgtctctgggctccgggctgaagatgaggctgattatttctgcagctcatatgcaggcagcaacaattttgtgatattcggcggagggaccaagctgaccgtcctaggtcagcccaaggctcg

SEQ ID NO: 535714 - DNA, 442 bp, Homo sapiens
  misc_feature: HIJSMM301BF67D.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccacccctcctcgtatctctcg

SEQ ID NO: 535715 - DNA, 487 bp, Homo sapiens
  misc_feature: HIJSMM301BBY53.40.37.D04.1.454.light.4.raw
tctagcgactcacgaccggtgctcgatttagtagcatactgttgggtttggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcggtcagtgacagatttcacactgaaaatcagccgggtggaggctgaggatgttggggttattactgcatgcaaggtttataccttcctcggactttcggtcccgtcggacgacgagtggatgtcaacgaactagt

SEQ ID NO: 535716 - DNA, 494 bp, Homo sapiens; identical to SEQ ID NO: 535629
  misc_feature: HIJSMM301B70AF.4.27.C05.1.454.light.4.raw

SEQ ID NO: 535717 - DNA, 505 bp, Homo sapiens; identical to SEQ ID NO: 535503
  misc_feature: HIJSMM301EPWRR.8.28.C06.1.454.light.4.raw

SEQ ID NO: 535718 - DNA, 509 bp, Homo sapiens
  misc_feature: HIJSMM301C45GF.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgcca

SEQ ID NO: 535719 - DNA, 513 bp, Homo sapiens
  misc_feature: HIJSMM301BWYQO.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcct

SEQ ID NO: 535720 - DNA, 444 bp, Homo sapiens; identical to SEQ ID NO: 535411
  misc_feature: HIJSMM301BK7MJ.8.73.G07.1.454.light.4.raw

SEQ ID NO: 535721 - DNA, 477 bp, Homo sapiens; identical to SEQ ID NO: 535122
  misc_feature: HIJSMM301DUE4A.26.72.G06.1.454.light.4.raw

SEQ ID NO: 535722 - DNA, 494 bp, Homo sapiens; identical to SEQ ID NO: 534992
  misc_feature: HIJSMM301ANAS2.9.1.A01.1.454.light.4.raw

SEQ ID NO: 535723 - DNA, 486 bp, Homo sapiens; identical to SEQ ID NO: 535043
  misc_feature: HIJSMM301CAKM1.46.35.D02.1.454.light.4.raw

SEQ ID NO: 535724 - DNA, 500 bp, Homo sapiens
  misc_feature: HIJSMM301DCKQ2.10.43.D10.1.454.light.4.raw
catagtagtgcacgaccggtgctcgatttagactagcagtaaggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtcttcat

SEQ ID NO: 535725 - DNA, 488 bp, Homo sapiens
  misc_feature: HIJSMM301AIHMD.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggccaggggaccaagctggagatcaggcgtaacg

SEQ ID NO: 535726 - DNA, 491 bp, Homo sapiens
  misc_feature: HIJSMM301EE5QD.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccgaaggcggaggatcagacgaactgtggctgcaccatctgtcttcta

SEQ ID NO: 535727 - DNA, 508 bp, Homo sapiens
  misc_feature: HIJSMM301AX8NG.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtgccaggaccgaacggtaggaatacaaacgaactacgtggcgtgcgaccactctgtcttctactctttccccg

SEQ ID NO: 535728 - DNA, 510 bp, Homo sapiens
  misc_feature: HIJSMM301BH7KK.13.4.A04.1.454.light.4.raw
  modified_base (497)..(497): a, c, t, g, unknown or other
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccnctgtcactctgtt

SEQ ID NO: 535729 - DNA, 495 bp, Homo sapiens
  misc_feature: HIJSMM301BZA3B.52.36.D03.1.454.light.4.raw
cgcagtacgacacgaccggtgctcgatttagctgcgtcacgatctctcttggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactgggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgaccgtctacgtcagccaaggctgccccctcggtcactctgtt

SEQ ID NO: 535730 - DNA, 494 bp, Homo sapiens; identical to SEQ ID NO: 534992
  misc_feature: HIJSMM301EPMUN.9.1.A01.1.454.light.4.raw

SEQ ID NO: 535731 - DNA, 495 bp, Homo sapiens
  misc_feature: HIJSMM301CEKHJ.16.78.H01.1.454.light.4.raw
tgtactactccacgaccggtgctcgatttagtgtgagtagtttgggtttggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgt

SEQ ID NO: 535732 - DNA, 468 bp, Homo sapiens
  misc_feature: HIJSMM301A9K6Y.8.73.G07.1.454.light.4.raw
  modified_base (438)..(438): a, c, t, g, unknown or other
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgacncgcgcgctgcggcggcgtcggacgaggccg

SEQ ID NO: 535733 - DNA, 499 bp, Homo sapiens
  misc_feature: HIJSMM301DID63.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggtgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaatagaggtcaacgaactgtggctgcaccatctgtcttcat

SEQ ID NO: 535734 - DNA, 497 bp, Homo sapiens
  misc_feature: HIJSMM301C1JFJ.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagttacctactcttttctcttcggaactgggaccacggtcaccgtcctaggtcagcccaaggccaaccccactgtcactctgttccccgccctcctcgtatct

SEQ ID NO: 535735 - DNA, 506 bp, Homo sapiens
  misc_feature: HIJSMM301ASL85.48.58.F03.1.454.light.4.raw
agtatacatacacgaccggtgctcgatttagtctgatcgagaagggaaaggggaggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgttcggaccttcggtccaagggacgacggactggagattaaacgaactagtggcgtgca

SEQ ID NO: 535736 - DNA, 480 bp, Homo sapiens; identical to SEQ ID NO: 535291
  misc_feature: HIJSMM301BXXRT.22.59.F04.1.454.light.4.raw

SEQ ID NO: 535737 - DNA, 493 bp, Homo sapiens
  misc_feature: HIJSMM301BDJ76.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcacctcggtccgaacggacgacgactggaggattaaacgaactgtggctgcaccatctgtcttcat

SEQ ID NO: 535738 - DNA, 486 bp, Homo sapiens; identical to SEQ ID NO: 535043
  misc_feature: HIJSMM301AI06H.46.35.D02.1.454.light.4.raw

SEQ ID NO: 535739 - DNA, 485 bp, Homo sapiens
  misc_feature: HIJSMM301D7EID.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcggcaaggaccaaggtggaatcaacgaactgtggctgcaccatctgtcttcta

SEQ ID NO: 535740 - DNA, 497 bp, Homo sapiens
  misc_feature: HIJSMM301A3ITM.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtcactctcg

SEQ ID NO: 535741 - DNA, 488 bp, Homo sapiens
  misc_feature: HIJSMM301DX85Y.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctcccgtgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgt

SEQ ID NO: 535742 - DNA, 479 bp, Homo sapiens
  misc_feature: HIJSMM301BJOOY.41.36.D03.1.454.light.4.raw
tctatactatcacgaccggtgctcgatttagctgcgtcacgatctctcttgggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgaccgtccg

SEQ ID NO: 535743 - DNA, 485 bp, Homo sapiens
  misc_feature: HIJSMM301BYL4U.14.55.E11.1.454.light.4.raw
  modified_base (424)..(424): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccncctctacgttcggacggacggaccgaggcggagatacagacgaactggtcggctcgaccac

SEQ ID NO: 535744 - DNA, 497 bp, Homo sapiens
  misc_feature: HIJSMM301BJCO6.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtctagcagtataataactggcctccacggtacacttttggccaggggaccaagctggagatcaaacgaactgtggctgcaccatctgt

SEQ ID NO: 535745 - DNA, 493 bp, Homo sapiens
  misc_feature: HIJSMM301EANUE.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggccaggggaccaacctggagatcaaatgaactgtggctgcaccatctgtctt

SEQ ID NO: 535746 - DNA, 501 bp, Homo sapiens
  misc_feature: HIJSMM301BOOGL.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtctt

SEQ ID NO: 535747 - DNA, 504 bp, Homo sapiens
  misc_feature: HIJSMM301BNHLU.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaagctgaccgtcctaggtcagcccaacggcg

SEQ ID NO: 535748 - DNA, 490 bp, Homo sapiens
  misc_feature: HIJSMM301AGTGI.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaacgaa

SEQ ID NO: 535749 - DNA, 485 bp, Homo sapiens
  misc_feature: HIJSMM301C9SPA.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaactttggccaggggaccaagctggagatcaaacgaactgtggctgcaccat

SEQ ID NO: 535750 - DNA, 465 bp, Homo sapiens; identical to SEQ ID NO: 535060
  misc_feature: HIJSMM301C4UP8.3.20.B09.1.454.light.4.raw

SEQ ID NO: 535751 - DNA, 492 bp, Homo sapiens
  misc_feature: HIJSMM301DOWZV.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggcgtgaggatgttggcatttattactgcatgcaggctatacaccttccttgccacttttggtccaggggaccaagctggagatcaggcgtaacg

SEQ ID NO: 535752 - DNA, 489 bp, Homo sapiens
  misc_feature: HIJSMM301ECYIH.52.34.D01.1.454.light.4.raw
cgcagtacgacacgaccggtgctcgatttagatcgtctgtgttgggtttgggggaggctctggggaggtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcagtttgggtgttcggcggagggaccaagttgaccgtctaggtcagcccaaggctgccccc

SEQ ID NO: 535753 - DNA, 500 bp, Homo sapiens
  misc_feature: HIJSMM301A4Z3R.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgtaggctgaagatgtggcagtttattattgtcagcaatattatattcctcctcagacgttcggccaagggaccaacggtaggaaatacaaacgaaactgtggctgcacc

SEQ ID NO: 535754 - DNA, 480 bp, Homo sapiens
  misc_feature: HIJSMM301DFHUP.46.35.D02.1.454.light.4.raw
actagcagtacacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccagaactttggccagggacaagctggagatcaacgaactgtggctgcaccat

SEQ ID NO: 535755 - DNA, 499 bp, Homo sapiens
  misc_feature: HIJSMM301AIO0C.47.66.F11.1.454.light.4.raw
agctcacgtacacgaccggtgctcgatttagtcacgcgagaaaggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttattactgtcagcagcgtaacaattggccgatcaccttcggccaagggacacgactggagattaaacgaactgtggctgcaccatctgtcttcatcttcccgcat

SEQ ID NO: 535756 - DNA, 493 bp, Homo sapiens
  misc_feature: HIJSMM301AVY12.10.6.A06.1.454.light.4.raw
catagtagtgcacgaccggtgctcgatttagatctactgacaacacgacaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaatcataattcatgatgtcaataatcggccctcaggggtttctaatcgcttctctggcttcaagtctggcaacacggcctcctgaccatctctgggctccaggctgaggacgaggctgattatactgcagctcatatacaaccagcagcactcgggtgttcggcggagggaccaagctgaccgtcctaggtcagcccaaggctg

SEQ ID NO: 535757 - DNA, 484 bp, Homo sapiens
  misc_feature: HIJSMM301AGKZL.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccgaaggtggagatcaacgaa

SEQ ID NO: 535758 - DNA, 486 bp, Homo sapiens; identical to SEQ ID NO: 535043
  misc_feature: HIJSMM301CY3EU.46.35.D02.1.454.light.4.raw

SEQ ID NO: 535759 - DNA, 434 bp, Homo sapiens; identical to SEQ ID NO: 535153
  misc_feature: HIJSMM301C3FGJ.18.5.A05.1.454.light.4.raw

SEQ ID NO: 535760 - DNA, 501 bp, Homo sapiens
  misc_feature: HIJSMM301AP83Q.48.36.D03.1.454.light.4.raw
agtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggtaactgggaccgaggtcaccgtcctaggtcagcccaaggccaacccca

SEQ ID NO: 535761 - DNA, 445 bp, Homo sapiens
  misc_feature: HIJSMM301B23FG.18.9.A09.1.454.light.4.raw
  modified_base (427)..(427): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcacgtcctaagtcagcccaaggccaaccctctgtcactctgttcccnccctcctccatactcgta

SEQ ID NO: 535762 - DNA, 443 bp, Homo sapiens
  misc_feature: HIJSMM301C2UGG.9.9.A09.1.454.light.4.raw
tgatacgtctcacgaccggtgctcgatttagcgagacgcgcagggtcctgggcccagtctgtgctgacgaagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccgccctcctcagacgtatca

SEQ ID NO: 535763 - DNA, 491 bp, Homo sapiens; identical to SEQ ID NO: 535194
  misc_feature: HIJSMM301DN5JB.26.78.H01.1.454.light.4.raw

SEQ ID NO: 535764 - DNA, 497 bp, Homo sapiens
  misc_feature: HIJSMM301APIYC.22.20.B09.1.454.light.4.raw
acatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccgggtcagactatctgctcaccatcggcggtctggaacctgaagattctgcactatattactgtcagctttatgttaattcacctccgtcgtacatctttggccaggggaccaagctggagatcaaacgaactgtggctgcaccatctgtcttcatt

SEQ ID NO: 535765 - DNA, 491 bp, Homo sapiens
  misc_feature: HIJSMM301EDUQQ.21.4.A04.1.454.light.4.raw
tcgtcgctcgcacgaccggtgctcgatttagagtagtgatcagggggaagagctgctcagttaggacccagagggaaccatggaaaccccacgcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatccccagacaggttcagtggcagtggggtctgggacagacttcactctcatcattagcagactggagcctgaagatttcgcagtgtattactgtcagcagtatggaagttcacctctgtcgttcggccaagggaccaaggtagaaatgaaacgaactgtggctgcaccat

SEQ ID NO: 535766 - DNA, 486 bp, Homo sapiens; identical to SEQ ID NO: 535054
  misc_feature: HIJSMM301BWXXB.47.70.G04.1.454.light.4.raw

SEQ ID NO: 535767 - DNA, 486 bp, Homo sapiens; identical to SEQ ID NO: 535043
  misc_feature: HIJSMM301AL54G.46.35.D02.1.454.light.4.raw

SEQ ID NO: 535768 - DNA, 486 bp, Homo sapiens; identical to SEQ ID NO: 535385
  misc_feature: HIJSMM301EUAPF.19.71.G05.1.454.light.4.raw

SEQ ID NO: 535769 - DNA, 501 bp, Homo sapiens
  misc_feature: HIJSMM301BQH8M.41.35.D02.1.454.light.4.raw
tctatactatcacgaccggtgctcgatttagcacacgatagttgggtttgggggctttgcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggacggagggaccaagctgaccgtcctaggtcagcccaaggctgccccctcggtcactctgttcccgccctcctacatagtataga

SEQ ID NO: 535770 - DNA, 493 bp, Homo sapiens
  misc_feature: HIJSMM301EJXZJ.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtca

SEQ ID NO: 535771 - DNA, 494 bp, Homo sapiens
  misc_feature: HIJSMM301EIL87.17.26.C04.1.454.light.4.raw
cgtagactagcacgaccggtgctcgatttagtctagcgactttgggtttggggaggtcagtctcagtcaggacacagcatggacatgagggtccccgcctcagctcctggggcgtcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagattttcactctcaccatcagcagtctgcaacctgaagattttgtcaacttactactgtcaacagagttacaatacccctccggctcactttcggtcggagggaccgaaggtggaggatcaaacgaactgtggctgcacca

SEQ ID NO: 535772 - DNA, 492 bp, Homo sapiens
  misc_feature: HIJSMM301EP2UQ.49.46.E02.1.454.light.4.raw
agtcgagagacacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccacggacagacggccaggatcacctgctctggagatgcattgccaaaccgatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcgggaggaccaagctgaccgtcctaggtcagcccaaggctgccccctcc

SEQ ID NO: 535773 - DNA, 520 bp, Homo sapiens
  misc_feature: HIJSMM301EN5KJ.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccaccctcct

SEQ ID NO: 535774 - DNA, 505 bp, Homo sapiens; identical to SEQ ID NO: 535503
  misc_feature: HIJSMM301BSUI5.8.28.C06.1.454.light.4.raw

SEQ ID NO: 535775 - DNA, 499 bp, Homo sapiens
  misc_feature: HIJSMM301BGIAO.14.55.E11.1.454.light.4.raw
  modified_base (460)..(460): a, c, t, g, unknown or other
  modified_base (483)..(483): a, c, t, g, unknown or other
cgtctagtaccacgaccggtgctcgatttagcactcgcacgttgggtttgggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagatttgtcaacttactactgtcaacagagttacacgtacccctccctctacgtcggtcggacggaacgacggaggacanacacgacgtaacgtgtggcgtcncacctactcgtctctt

SEQ ID NO: 535776 - DNA, 489 bp, Homo sapiens
  misc_feature: HIJSMM301BGGEF.4.52.E08.1.454.light.4.raw
agcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccgacagggccactggcatcccagccaggttcagtggcagtgggtctgggacagacttcactctcaccatcaccagcctagagcctgaggattttgcagtttattactgtcagcagcgtagcaactggcctctgctcactttcggcggagggaccaaggtggagatcaaacgaactgtggctgcacca

SEQ ID NO: 535777 - DNA, 483 bp, Homo sapiens
  misc_feature: HIJSMM301D68KM.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtcagcccg

SEQ ID NO: 535778 - DNA, 483 bp, Homo sapiens
  misc_feature: HIJSMM301A1FVB.48.84.H07.1.454.light.4.raw
agtatacatacacgaccggtgctcgatttagcagacgtctgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgaccgtcctaggtcacg

SEQ ID NO: 535779 - DNA, 404 bp, Homo sapiens
  misc_feature: HIJSMM301ASK3U.4.35.D02.1.454.light.4.raw
agcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgtcactctgttcccgccctcctcctacagtgct

SEQ ID NO: 535780 - DNA, 479 bp, Homo sapiens
  misc_feature: HIJSMM301CZZ4U.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatatatacttctcttccgatcactttggtcagggaccgaggctggagatcagacgaactgt

SEQ ID NO: 535781 - DNA, 481 bp, Homo sapiens
  misc_feature: HIJSMM301BGVTI.46.26.C04.1.454.light.4.raw
  modified_base (443)..(443): a, c, t, g, unknown or other
actagcagtacacgaccggtgctcgatttagtctagcgactttgggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggagctgaggatgttgggctctattattgcatgcaagctctacaagtcccgntcactttcggcggaggaccaaggtggagatcaaacgaa

SEQ ID NO: 535782 - DNA, 482 bp, Homo sapiens
  misc_feature: HIJSMM301AHSKQ.46.35.D02.1.454.light.4.raw
actagcagtacacgaccggtgctcgatttagcacacgatagttgggtttggggagctgctcagttaggacccagagggaaccatggaaaccccacgcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagaactttggccagggaccaagctggagatcaacgaactgtggctgcaccat

SEQ ID NO: 535783 - DNA, 501 bp, Homo sapiens
  misc_feature: HIJSMM301CO4C7.10.43.D10.1.454.light.4.raw
catagtagtgcacgaccggtgctcgatttagactagcagtaaggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtcttcatt

SEQ ID NO: 535784 - DNA, 484 bp, Homo sapiens
  misc_feature: HIJSMM301ELYR2.49.3.A03.1.454.light.4.raw
agtcgagagacacgaccggtgctcgatttagagagcgtcacaggggaggaactgctcagttaggacccagacggaaccatggaagccccagcgcagcttctcttcctcctgctactctggctcccagataccactggagaaatagtgatgacgcagtctccagccactttgtctgtgtctccaggggagagagccactctctcctgcaggaccagtcagagtgttaataacaagttagcctggtaccagcagagacctggccaggctcccaggctcctcatctatgatgtgtctaccagggccactggtatcccagccaggttcagtggcagtgggtctggggcggagttcactctcaccatcagcagcctgcagtctgaagattttgcagtttattactgtcagcactctaatgactggcccctgtacacttttggcccgggaccaaggtggagatcaaacgaactgtggctgcaccatctgt

SEQ ID NO: 535785 - DNA, 444 bp, Homo sapiens; identical to SEQ ID NO: 535027
  misc_feature: HIJSMM301DRCYZ.8.73.G07.1.454.light.4.raw

SEQ ID NO: 535786 - DNA, 486 bp, Homo sapiens; identical to SEQ ID NO: 535043
  misc_feature: HIJSMM301C6RL4.46.35.D02.1.454.light.4.raw

SEQ ID NO: 535787 - DNA, 495 bp, Homo sapiens
  misc_feature: HIJSMM301CISWJ.8.10.A10.1.454.light.4.raw
ctcgcgtgtccacgaccggtgctcgatttagcgtcgatctcaggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacagacttcactctcaccatcagcagcctagagcctgaagattttgcactttattactgtcagcagcgtagtaactggcctttcactttcggccctgggaccaaagtggatatcaacgaactgtggctgcaccatctgtcttcatcttcccgccat

SEQ ID NO: 535788 - DNA, 447 bp, Homo sapiens; identical to SEQ ID NO: 535201
  misc_feature: HIJSMM301CFGYC.18.9.A09.1.454.light.4.raw

SEQ ID NO: 535789 - DNA, 487 bp, Homo sapiens
  misc_feature: HIJSMM301AM54P.40.38.D05.1.454.light.4.raw
tctagcgactcacgaccggtgctcgatttagtatctgatagttgggtttgggggatcaggacttctcagttcatcttctcaccatgaggctccctgctcagctcctggggctgctaatgctctggatccctggttccagtgcggagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggacttcgtcctcggacgacgagtggagtgtcgtaacgaact

SEQ ID NO: 535790 - DNA, 492 bp, Homo sapiens
  misc_feature: HIJSMM301BJIFV.40.81.H04.1.454.light.4.raw
tctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctccctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgca

SEQ ID NO: 535791 - DNA, 486 bp, Homo sapiens; identical to SEQ ID NO: 535385
  misc_feature: HIJSMM301EASN0.19.71.G05.1.454.light.4.raw

SEQ ID NO: 535792 - DNA, 511 bp, Homo sapiens
  misc_feature: HIJSMM301C70HU.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggtacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaaggtggaaaagtcaaaacgaactagtggctgcaccaatctgtcttctactcttccccg

SEQ ID NO: 535793 - DNA, 453 bp, Homo sapiens
  misc_feature: HIJSMM301DTXOK.18.78.H01.1.454.light.4.raw
tacgagtatgcacgaccggtgctcgatttagtgtgagtagtttgggtttggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgccctcctccatactcgta

SEQ ID NO: 535794 - DNA, 447 bp, Homo sapiens; identical to SEQ ID NO: 535020
  misc_feature: HIJSMM301B2TRD.18.9.A09.1.454.light.4.raw

SEQ ID NO: 535795 - DNA, 500 bp, Homo sapiens
  misc_feature: HIJSMM301B55YB.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccgaaggtaggaaatacaaacgaaactgtggctgcaccatctgtcttcatt

SEQ ID NO: 535796 - DNA, 482 bp, Homo sapiens
  misc_feature: HIJSMM301CMBYF.51.64.F09.1.454.light.4.raw
cgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttctaacaacctagcctggtatcagcagaagcctggccaggctcccaggctcctcatctatggttcatccaccagggccgctgatatcccagccaggttcagtggcagtgggtctgggacagaattcactctcaccatcagcagcctgcagtctgaagattttgcagtttattactgtcagcagtatgataagtggcctccgtacacttttggccaggggaccaggctggagatcaaacgaactgtggctgcaccat

SEQ ID NO: 535797 - DNA, 496 bp, Homo sapiens; identical to SEQ ID NO: 535541
  misc_feature: HIJSMM301DWSIF.3.33.C11.1.454.light.4.raw

SEQ ID NO: 535798 - DNA, 464 bp, Homo sapiens
  misc_feature: HIJSMM301BN9ER.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcagggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttccccaccctcctccatactcgta

SEQ ID NO: 535799 - DNA, 417 bp, Homo sapiens
  misc_feature: HIJSMM301CB4JW.18.78.H01.1.454.light.4.raw
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaaggccaaccccactgtcactctgttccccgccctcctccatactcgta

SEQ ID NO: 535800 - DNA, 441 bp, Homo sapiens; identical to SEQ ID NO: 535074
  misc_feature: HIJSMM301AULJ4.11.3.A03.1.454.light.4.raw

SEQ ID NO: 535801 - DNA, 513 bp, Homo sapiens; identical to SEQ ID NO: 535719
  misc_feature: HIJSMM301BIV04.17.33.C11.1.454.light.4.raw

SEQ ID NO: 535802 - DNA, 483 bp, Homo sapiens
  misc_feature: HIJSMM301C9R61.13.36.D03.1.454.light.4.raw
tcacgtactacacgaccggtgctcgatttagctgcgtcacgatctctcttggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacgactggagattaaagga

SEQ ID NO: 535803 - DNA, 487 bp, Homo sapiens
  misc_feature: HIJSMM301CIVGO.4.26.C04.1.454.light.4.raw
agcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagatttttacactgaaaatcagcagagtggaggctgaggatgttgggctctattattgcatgcaagctctacaagtcccgctcacttttcggcggagggaccaagtggagatcaaacgaacg

SEQ ID NO: 535804 - DNA, 448 bp, Homo sapiens
  misc_feature: HIJSMM301BZI4H.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactagtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaacggccaacccctctgtcactctgttcccgccctcctccatactcgta

SEQ ID NO: 535805 - DNA, 448 bp, Homo sapiens; identical to SEQ ID NO: 534998
  misc_feature: HIJSMM301COS8S.18.9.A09.1.454.light.4.raw

SEQ ID NO: 535806 - DNA, 495 bp, Homo sapiens
  misc_feature: HIJSMM301CZKHK.21.27.C05.1.454.light.4.raw
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccaaggtggaaatacaacgaactgtggctgcaccatctgtctt

SEQ ID NO: 535807 - DNA, 490 bp, Homo sapiens
  misc_feature: HIJSMM301CQ895.16.68.G02.1.454.light.4.raw
tgtactactccacgaccggtgctcgatttagtcgatagtgaagggaaaggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatt

SEQ ID NO: 535808 - DNA, 496 bp, Homo sapiens
  misc_feature: HIJSMM301B4JNG.16.78.H01.1.454.light.4.raw
tgtactactccacgaccggtgctcgatttagtgtgagtagtttgggtttggggaggaactgctcagttaggacccagacggaaccatggaagccccacgcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccagggaccaagctggagatcaaacgaactgtggctgcaccatctgtt

SEQ ID NO: 535809 - DNA, 488 bp, Homo sapiens
  misc_feature: HIJSMM301CAUVN.51.60.F05.1.454.light.4.raw
cgatcgtatacacgaccggtgctcgatttagtacgtcatcagggaaagggcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacacctacttgacttggtttcagcagaggcctggccaatctccaaggcgccttatttataaggtttctaatcgggactttggggtcccagacagattcagcggcagtgggtcacgcactcacttcacactgaaaatcagcagggtggaggctgaggatttaggggtttattactgcatgcaaggtacacactggcctccgtacacttttggccaggggaccaagctcgagatcaaacgaactgtggctgcaccatctgtcttcatcttcccgccatctgatcgtagcact

SEQ ID NO: 535810 - DNA, 487 bp, Homo sapiens; identical to SEQ ID NO: 535358
  misc_feature: HIJSMM301DLYH4.47.70.G04.1.454.light.4.raw

SEQ ID NO: 535811 - DNA, 432 bp, Homo sapiens
  misc_feature: HIJSMM301A17UF.14.5.A05.1.454.light.4.raw
cgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctcctgcgctcactttcggcggagggaccaaggtggagatcaaacgaactgtggctgcaccatctgtcttcatcttcccgccatctgagtactagacg

SEQ ID NO: 535812 - DNA, 497 bp, Homo sapiens
  misc_feature: HIJSMM301CMCV7.40.17.B06.1.454.light.4.raw
tctagcgactcacgaccggtgctcgatttagtcgatagtgaagggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatctataaggcgtctagtttagaaagtggggtcccatcaaggatcagcggcagtggatctgggacagaattcactctcaccattagtagcctgcagcctgatgattttgcaacttattactgccaacaatataatgattttccgtggacgttcggccaagggaccaaggtagaaatcaaacgaactgtggctgcaccatctgtcttcatcttcccgcca

SEQ ID NO: 535813 - DNA, 447 bp, Homo sapiens; identical to SEQ ID NO: 535020
  misc_feature: HIJSMM301BBYFV.18.9.A09.1.454.light.4.raw

SEQ ID NO: 535814 - DNA, 479 bp, Homo sapiens; identical to SEQ ID NO: 535586
  misc_feature: HIJSMM301CO91Z.13.34.D01.1.454.light.4.raw

SEQ ID NO: 535815 - DNA, 501 bp, Homo sapiens
  misc_feature: HIJSMM301AFUJQ.18.11.A11.1.454.light.4.raw
tacgagtatgcacgaccggtgctcgatttagctacgactgcagggggagctacaacaggcaggcaggggcgagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggaggaccaaggtggagatcaaacgaactgtggctgcaccatctgtctt

SEQ ID NO: 535816 - DNA, 484 bp, Homo sapiens; identical to SEQ ID NO: 535240
  misc_feature: HIJSMM301CDZWQ.47.60.F05.1.454.light.4.raw

SEQ ID NO: 535817 - DNA, 500 bp, Homo sapiens
  misc_feature: HIJSMM301CK3SP.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaaggaccgaagtggaaatcaaacgaactgtggctgcaccatctgtcttcatcttccccg

SEQ ID NO: 535818 - DNA, 504 bp, Homo sapiens
  misc_feature: HIJSMM301AQ4MZ.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttccccg

SEQ ID NO: 535819 - DNA, 484 bp, Homo sapiens
  misc_feature: HIJSMM301BPLZB.41.34.D01.1.454.light.4.raw
tctatactatcacgaccggtgctcgatttagatcgtctgtgttgggtttggggaggtcagacccacgtcaggacacagcatggacatgagggtccccgcctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcacc

SEQ ID NO: 535820 - DNA, 488 bp, Homo sapiens
  misc_feature: HIJSMM301CSM0I.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacatatgatatttattctccagcgttcggccagggaccgaaggtggaagtcaagcgaactgtggctgcaccatctgtt

SEQ ID NO: 535821 - DNA, 495 bp, Homo sapiens
  misc_feature: HIJSMM301DO4EK.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgaactgtggctgcaccatctgtctt

SEQ ID NO: 535822 - DNA, 485 bp, Homo sapiens
  misc_feature: HIJSMM301AWB72.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggtcta

SEQ ID NO: 535823 - DNA, 503 bp, Homo sapiens
  misc_feature: HIJSMM301EC840.48.70.G04.1.454.light.4.raw
  modified_base (444)..(444): a, c, t, g, unknown or other
  modified_base (492)..(492): a, c, t, g, unknown or other
agtatacatacacgaccggtgctcgatttagtgtagtgtgaagggaaaggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccnccgacgtcgtcgggccggaacgtacgaagacaacgaactagtggtcgngtcaccactct

SEQ ID NO: 535824 - DNA, 484 bp, Homo sapiens
  misc_feature: HIJSMM301D52XF.46.35.D02.1.454.light.4.raw
actagcagtacacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgcagtctattactgtcagcagtatggtcacgtcccaagaacttttggccaggggaccaagctggagatcaaacgaactgtggctgcaccat

SEQ ID NO: 535825 - DNA, 508 bp, Homo sapiens
  misc_feature: HIJSMM301EMX2W.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaataaaacgaactgtggctgcaccatctgtcttcat

SEQ ID NO: 535826 - DNA, 453 bp, Homo sapiens; identical to SEQ ID NO: 535650
  misc_feature: HIJSMM301BSQR8.19.86.H09.1.454.light.4.raw

SEQ ID NO: 535827 - DNA, 487 bp, Homo sapiens
  misc_feature: HIJSMM301B4QZW.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggtccaagggaccgaacggtaggaaagtacaaacgaactagtggctgcacca

SEQ ID NO: 535828 - DNA, 494 bp, Homo sapiens
  misc_feature: HIJSMM301ADH4D.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgcagtttattactgtcagcagtatggtacttcacaaaccttcggccaggggacacgactggagattaagcgaactgtggctgcaccatctgtctt

SEQ ID NO: 535829 - DNA, 497 bp, Homo sapiens
  misc_feature: HIJSMM301AZ7Z0.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaagctgaccgtcctaggtcagccc

SEQ ID NO: 535830 - DNA, 490 bp, Homo sapiens; identical to SEQ ID NO: 535807
  misc_feature: HIJSMM301BITMC.16.68.G02.1.454.light.4.raw

SEQ ID NO: 535831 - DNA, 487 bp, Homo sapiens
  misc_feature: HIJSMM301ERIOL.47.60.F05.1.454.light.4.raw
agctcacgtacacgaccggtgctcgatttagtacgtcatcagggaaagggggagggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagtattttgcagttttattactgtcagcagtatcatgactggccgctcaccttcggccaagggacacgactggagattaaacgaactgtggctgcaccat

SEQ ID NO: 535832 - DNA, 482 bp, Homo sapiens
  misc_feature: HIJSMM301D0BZO.47.60.F05.1.454.light.4.raw
agctcacgtacacgaccggtgctcgatttagtacgtcatcagggaaaggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgactgtggctgcaccat

SEQ ID NO: 535833 - DNA, 441 bp, Homo sapiens; identical to SEQ ID NO: 534971
  misc_feature: HIJSMM301CR8S5.11.3.A03.1.454.light.4.raw

SEQ ID NO: 535834 - DNA, 494 bp, Homo sapiens
  misc_feature: HIJSMM301ES05L.49.61.F06.1.454.light.4.raw
agtcgagagacacgaccggtgctcgatttagctacgctctaagggaaaggggaagagctgctcagttaggacccagagggaaccatggaaaccccagcgcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgt

SEQ ID NO: 535835 - DNA, 508 bp, Homo sapiens
  misc_feature: HIJSMM301AUU7M.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaaagtggatatcaaacgaactgtggctgcaccatctgtcttcta

SEQ ID NO: 535836 - DNA, 445 bp, Homo sapiens
  misc_feature: HIJSMM301ES8QQ.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtcccgtgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctcgccccctcggtcactctgttcccaccctcctcgtgtctgat

SEQ ID NO: 535837 - DNA, 479 bp, Homo sapiens
  misc_feature: HIJSMM301APZJG.3.82.H05.1.454.light.4.raw
agacgcactccacgaccggtgctcgatttagtcgagctctctcgcgggggcaggagtcagacccacgtcaggacacagcatggacatgagggtccccgcctcagctcctggggcgtcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctccccgctcactttcggcggagggaccaaggtggagatcaaacgaactgtgg

SEQ ID NO: 535838 - DNA, 493 bp, Homo sapiens
  misc_feature: HIJSMM301B2GAI.4.24.C02.1.454.light.4.raw
agcactgtagcacgaccggtgctcgatttagtacagatcgttagggaaagggggaggtcagactcagtcaggacacagcatggacatgagggtccccggcctcagctcctggggcgtcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataacagttattggacgttcgccaagggaccaaggtggaaatcagacgaactgtggctgcaccatcttgtcttc

SEQ ID NO: 535839 - DNA, 509 bp, Homo sapiens
  misc_feature: HIJSMM301BFNS4.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccgacgggaccgacacgtagaaatagagacgaactagtggcgtgcgaccatctgtcttctatcttcccgt

SEQ ID NO: 535840 - DNA, 496 bp, Homo sapiens
  misc_feature: HIJSMM301EWD93.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccgaagctgaccgtcctaggtcagccc

SEQ ID NO: 535841 - DNA, 505 bp, Homo sapiens
  misc_feature: HIJSMM301BTDBV.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccaaggtaggaaatacaaacgaactgtggctgcaccatctgtcttcatcttccccg

SEQ ID NO: 535842 - DNA, 498 bp, Homo sapiens
  misc_feature: HIJSMM301BSSLS.22.27.C05.1.454.light.4.raw
acatacgcgtcacgaccggtgctcgatttagacgcgatcgaagggtttggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtggctgcacca

SEQ ID NO: 535843 - DNA, 496 bp, Homo sapiens
  misc_feature: HIJSMM301A27VY.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcgaagatgaggctgactattactgtaactcccgggccagcagtggtaacattgtgatattcggcggagggaccaaggtgaccgtcctacgtcagcccaaggctgccccctcggtcactctcg

SEQ ID NO: 535844 - DNA, 463 bp, Homo sapiens; identical to SEQ ID NO: 535062
  misc_feature: HIJSMM301CCAAW.11.73.G07.1.454.light.4.raw

SEQ ID NO: 535845 - DNA, 474 bp, Homo sapiens
  misc_feature: HIJSMM301AS24L.13.48.E04.1.454.light.4.raw
tcacgtactacacgaccggtgctcgatttagagagcgtcacagagagaaggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgaatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaacggaccgaagtggaaatacaacgaaa

SEQ ID NO: 535846 - DNA, 449 bp, Homo sapiens
  misc_feature: HIJSMM301CR6DC.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactccgta

SEQ ID NO: 535847 - DNA, 480 bp, Homo sapiens
  misc_feature: HIJSMM301CK5VK.40.83.H06.1.454.light.4.raw
  modified_base (466)..(466): a, c, t, g, unknown or other
tctagcgactcacgaccggtgctcgatttagatcacgtgcgtcgcgggcaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggcttgactattaactgttcagcatgggacggcgagctccagtgaatggtgttcggcggagggacaaactanccgtcctaggtcag

SEQ ID NO: 535848 - DNA, 484 bp, Homo sapiens
  misc_feature: HIJSMM301CZNQS.17.34.D01.1.454.light.4.raw
cgtagactagcacgaccggtgctcgatttagatcgtctgtgttgggtttgggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccggtggaggctgaggacgttggaatttattactgtatgcaaggtatagagcttcctccgacgttcggccaagggaccaaggtggaactcaacgaa

SEQ ID NO: 535849 - DNA, 513 bp, Homo sapiens
  misc_feature: HIJSMM301ER4Y2.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttcggcggagggaccaagctgaccgtcctaggtcagcccaaggctgccccctcggtcactctgttccca

SEQ ID NO: 535850 - DNA, 484 bp, Homo sapiens
  misc_feature: HIJSMM301BDOSW.46.35.D02.1.454.light.4.raw
actagcagtacacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagtcaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgagattttgcagtctattactgtcagcagtatggtcacgtcccaagaacttttggccaggggaccaagctggagatcaaacgaactgtggctgcaccat

SEQ ID NO: 535851 - DNA, 496 bp, Homo sapiens; identical to SEQ ID NO: 535109
  misc_feature: HIJSMM301DCA2V.16.78.H01.1.454.light.4.raw

SEQ ID NO: 535852 - DNA, 447 bp, Homo sapiens; identical to SEQ ID NO: 535020
  misc_feature: HIJSMM301DH7VR.18.9.A09.1.454.light.4.raw

SEQ ID NO: 535853 - DNA, 490 bp, Homo sapiens
  misc_feature: HIJSMM301BOPWM.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatcccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaagggacacgactggagattaaacgaactgtggctgcaccatctgtcttcat

SEQ ID NO: 535854 - DNA, 489 bp, Homo sapiens
  misc_feature: HIJSMM301DJI74.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaacctacatgatttatgaggccacctaagcgaccctccagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctcgctacgtaga

SEQ ID NO: 535855 - DNA, 510 bp, Homo sapiens
  misc_feature: HIJSMM301CCQ73.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttccca

SEQ ID NO: 535856 - DNA, 444 bp, Homo sapiens
  misc_feature: HIJSMM301CJBWH.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccgccctcctcagacgtatca

SEQ ID NO: 535857 - DNA, 495 bp, Homo sapiens
  misc_feature: HIJSMM301AG5CT.47.64.F09.1.454.light.4.raw
agctcacgtacacgaccggtgctcgatttagcgcgtatacaagggggaggaactgctcagttaggacccacgagggaaccatggaagccccacgctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccgaggtgggagatcaaacgaactgtggctgcaccatctgtcttcat

SEQ ID NO: 535858 - DNA, 493 bp, Homo sapiens
  misc_feature: HIJSMM301DX2H9.3.31.C09.1.454.light.4.raw
agacgcactccacgaccggtgctcgatttagacgtctcatcaaggaaggaaggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaacgaactgtggctgcaccatctgtctt

SEQ ID NO: 535859 - DNA, 441 bp, Homo sapiens; identical to SEQ ID NO: 535074
  misc_feature: HIJSMM301EOFE4.11.3.A03.1.454.light.4.raw

SEQ ID NO: 535860 - DNA, 488 bp, Homo sapiens
  misc_feature: HIJSMM301D2D6X.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggtcggagggaccaagctgaccgtcctaggtcagcccaaggctgccccctcggtcactctgttccaccctcctcga

SEQ ID NO: 535861 - DNA, 488 bp, Homo sapiens
  misc_feature: HIJSMM301C9XS7.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttca

SEQ ID NO: 535862 - DNA, 488 bp, Homo sapiens
  misc_feature: HIJSMM301AQZUW.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacgggctgcccccaaccttcggccaggggacacgactggagattaaacgaactgtggctgcaccatctgtctt

SEQ ID NO: 535863 - DNA, 487 bp, Homo sapiens
  misc_feature: HIJSMM301BHRI7.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggataatcagacgaa

SEQ ID NO: 535864 - DNA, 492 bp, Homo sapiens
  misc_feature: HIJSMM301CVXNQ.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactccgggccagcagtggtaacattgtgatattcggcggagggaccaaggtgaccgtcctacgtcagcccaaggctgccccctcggtcact

SEQ ID NO: 535865 - DNA, 490 bp, Homo sapiens
  misc_feature: HIJSMM301C051M.5.11.A11.1.454.light.4.raw
atcagacacgcacgaccggtgctcgatttagctacgactgcaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttctgcatgcaaggtacacactggccgtacacttttggccaggggaccaagctggagatcaaacgaactgtggctgcacc

SEQ ID NO: 535866 - DNA, 486 bp, Homo sapiens
  misc_feature: HIJSMM301ANHLD.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaagaccaaccca

SEQ ID NO: 535867 - DNA, 459 bp, Homo sapiens
  misc_feature: HIJSMM301B83OH.19.71.G05.1.454.light.4.raw
tactctcgtgcacgaccggtgctcgatttagtgtcgtcgcaagagagagggggcacttctccctctaacactctccccagtctccagactccctggctgtgtctctgggcgagcgggccaccgatacgaactgacaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgcaccatctgtcttcatcttcccgccatctgacacgagagta

SEQ ID NO: 535868 - DNA, 484 bp, Homo sapiens
  misc_feature: HIJSMM301CU6C6.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggtccaggggaccaggctggagatcagacgaactgtgg

SEQ ID NO: 535869 - DNA, 444 bp, Homo sapiens; identical to SEQ ID NO: 535027
  misc_feature: HIJSMM301DW0O4.8.73.G07.1.454.light.4.raw

SEQ ID NO: 535870 - DNA, 494 bp, Homo sapiens; identical to SEQ ID NO: 535478
  misc_feature: HIJSMM301APLRT.10.79.H02.1.454.light.4.raw

SEQ ID NO: 535871 - DNA, 444 bp, Homo sapiens; identical to SEQ ID NO: 535594
  misc_feature: HIJSMM301A94QN.9.9.A09.1.454.light.4.raw

SEQ ID NO: 535872 - DNA, 506 bp, Homo sapiens
  misc_feature: HIJSMM301D0Z42.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttccgcc

SEQ ID NO: 535873 - DNA, 501 bp, Homo sapiens
  misc_feature: HIJSMM301C4R06.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctgccccctcggtca

SEQ ID NO: 535874 - DNA, 496 bp, Homo sapiens
  misc_feature: HIJSMM301CFQPV.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccaggtggaaatacaaacgaactagtggctgcaccatctgtcttcatt

SEQ ID NO: 535875 - DNA, 478 bp, Homo sapiens
  misc_feature: HIJSMM301DOFQK.43.60.F05.1.454.light.4.raw
tgtgagtagtcacgaccggtgctcgatttagtacgtcatcagggaaaggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttctaccctcggacgttcgcacggacgacggtggagtagtcaagacgaacgtagtggcgtgc

SEQ ID NO: 535876 - DNA, 488 bp, Homo sapiens
  misc_feature: HIJSMM301C689T.26.23.C01.1.454.light.4.raw
  modified_base (432)..(432): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatattattctccancgttcggccaggggaccaaggtggaagtcaagcgaactgtggctgcaccatctgtt

SEQ ID NO: 535877 - DNA, 502 bp, Homo sapiens
  misc_feature: HIJSMM301CPH05.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccgagggtaggaaagtacaaacgaaactgtggctgcaccatctgtcttcattcc

SEQ ID NO: 535878 - DNA, 497 bp, Homo sapiens
  misc_feature: HIJSMM301CWGO3.16.78.H01.1.454.light.4.raw
tgtactactccacgaccggtgctcgatttagtgtgagtagtttgggtttggggaggaactgctcagttaggacccagacggaaccatggaagccccacgcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatccccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgt

SEQ ID NO: 535879 - DNA, 465 bp, Homo sapiens
  misc_feature: HIJSMM301CVUNG.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctcaacgtgatgatgttgcaacatactattgtcagcaatatgattttgctctccgagtgccactttggcggggaccaagtggacatcaacgaa

SEQ ID NO: 535880 - DNA, 485 bp, Homo sapiens
  misc_feature: HIJSMM301BCKK5.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtggctgcaccatctgt

SEQ ID NO: 535881 - DNA, 490 bp, Homo sapiens
  misc_feature: HIJSMM301ELDEY.19.71.G05.1.454.light.4.raw
  modified_base (434)..(434): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggctagtttattattgtcaaanaatattattatactgtggacgttcggccaaggaccaaggtggataatcaagacgaa

SEQ ID NO: 535882 - DNA, 447 bp, Homo sapiens
  misc_feature: HIJSMM301BTF5W.18.9.A09.1.454.light.4.raw
  modified_base (429)..(429): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccnccctcctccatactcgta

SEQ ID NO: 535883 - DNA, 487 bp, Homo sapiens
  misc_feature: HIJSMM301APB1S.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccaaggtggatatcagacgaa

SEQ ID NO: 535884 - DNA, 489 bp, Homo sapiens
  misc_feature: HIJSMM301BIQDU.48.75.G09.1.454.light.4.raw
agtatacatacacgaccggtgctcgatttagtatagacatcagggggatcgggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccggggaccaaggtggatctcaaaagaactgtggctgcacc

SEQ ID NO: 535885 - DNA, 498 bp, Homo sapiens
  misc_feature: HIJSMM301ATXLY.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttactactgaaaatacagcagagtggaggctgaggatgttggggtttattactgcatgcaagctctacaaaactccttacactttggtccaggggaccgaagctggagatcaaacgaactgtggg

SEQ ID NO: 535886 - DNA, 497 bp, Homo sapiens
  misc_feature: HIJSMM301CUPH9.8.10.A10.1.454.light.4.raw
ctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacagacttcactctcaccatcagcagcctagagcctgaagattttgcactttattactgtcagcagcgtagtaactggcctttcactttcggccctgggaccaaagtggatatcaaacgaactgtggctgcaccatctgtcttcatcttcccgccat

SEQ ID NO: 535887 - DNA, 502 bp, Homo sapiens
  misc_feature: HIJSMM301A41VE.49.15.B04.1.454.light.4.raw
agtcgagagacacgaccggtgctcgatttagacagtatatatccgcgggcacgaccggtgctcgatttagtgtgagtagtttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagatttgcagtctattactgtcagcagcgttacaactggcctcccatgtacacttttggccaggggaccaagcta

SEQ ID NO: 535888 - DNA, 447 bp, Homo sapiens; identical to SEQ ID NO: 535882
  misc_feature: HIJSMM301ENZ6P.18.9.A09.1.454.light.4.raw
  modified_base (429)..(429): a, c, t, g, unknown or other

SEQ ID NO: 535889 - DNA, 502 bp, Homo sapiens
  misc_feature: HIJSMM301AMSOV.18.11.A11.1.454.light.4.raw
tacgagtatgcacgaccggtgctcgatttagctacgactgcagggggagctacaacaggcaggcaggggcgagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtctt

SEQ ID NO: 535890 - DNA, 493 bp, Homo sapiens
  misc_feature: HIJSMM301EQYRT.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttgaccaggggaccaacctggagatcaaatgaactgtggctgcaccatctgtctt

SEQ ID NO: 535891 - DNA, 493 bp, Homo sapiens
  misc_feature: HIJSMM301AM600.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccacgggaccgaacggtaggaaagtacaaacgaaactacgtggcgtgcacca

SEQ ID NO: 535892 - DNA, 444 bp, Homo sapiens; identical to SEQ ID NO: 535192
  misc_feature: HIJSMM301DDAMU.5.9.A09.1.454.light.4.raw

SEQ ID NO: 535893 - DNA, 479 bp, Homo sapiens
  misc_feature: HIJSMM301ANLAC.4.33.C11.1.454.light.4.raw
agcactgtagcacgaccggtgctcgatttagagtgagctcgttgggtttggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactgtggctgcacca

SEQ ID NO: 535894 - DNA, 483 bp, Homo sapiens
  misc_feature: HIJSMM301ATWB5.19.71.G05.1.454.light.4.raw
tactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatat

SEQ ID NO: 535895 - DNA, 445 bp, Homo sapiens
  misc_feature: HIJSMM301CZMB2.8.73.G07.1.454.light.4.raw
ctcgcgtgtccacgaccggtgctcgatttagctctacgctcagggtcctgggcccagtctgtactgacgcagccaccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcgggcggcgggaccaagttgaccgtcctacgtcagcccaaggctgccccctcggtcactctgttcccaccctcctcgacacgcgag

SEQ ID NO: 535896 - DNA, 503 bp, Homo sapiens
  misc_feature: HIJSMM301AUB7G.48.60.F05.1.454.light.4.raw
agtatacatacacgaccggtgctcgatttagtacgtcatcagggaaaggggaagagctgctcagttaggacccagagggaaccatggaaaccccagcgcagcttctcttcctcctgctactctggctcccagataccgccggagaaattttgttgacgcagtctccaggcaccctgtctttgtctccaggggaaagagccaccctctcctgcagggccagtcagtatgttagcagcaactacttagcctggtaccagcagaaacctggccaggctcccaggctcctcatctacggtgcatccagcagggccattggcatcccagacaggttcagtggcagtgggtctgggacaaacttcactctcaccatcagcagactggagcctgaagattttgcagtctattactgtcagcagtatactaactcacctaagacgttcggccaagggaccaaggtggaaatcaaacgaactgtggctgcaccatctgtcttcatcttcccg

SEQ ID NO: 535897 - DNA, 514 bp, Homo sapiens
  misc_feature: HIJSMM301EWD9Z.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggctgccccctcggtcactctgtcccgcctcctccacg

SEQ ID NO: 535898 - DNA, 472 bp, Homo sapiens
  misc_feature: HIJSMM301BBGE9.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctgtcttcatcttcccgccat

SEQ ID NO: 535899 - DNA, 499 bp, Homo sapiens
  misc_feature: HIJSMM301DIQR4.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttcccaccctcctccacgagagta

SEQ ID NO: 535900 - DNA, 481 bp, Homo sapiens
  misc_feature: HIJSMM301CWXQ5.51.64.F09.1.454.light.4.raw
cgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttctaacaacctagcctggtatcagcagaagcctggccaggctcctaggctcctcatctatggttcatccaccagggccgctgatatcccagccaggttcagtggcagtgggtctgggacagaattcactctcaccatcagcagcctgcagtctgaagattttgcagtttattactgtcagcagtatgataagtggcctccgtacacttttggccagggaccaggctggagatcaaacgaactgtggctgcaccat

SEQ ID NO: 535901 - DNA, 475 bp, Homo sapiens
  misc_feature: HIJSMM301A68MN.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaaggaccaaggtggaaatcaacgaactgtggctgca

SEQ ID NO: 535902 - DNA, 464 bp, Homo sapiens
  misc_feature: HIJSMM301B71GH.43.75.G09.1.454.light.4.raw
tgtgagtagtcacgaccggtgctcgatttagtatagacatcaggggaggaatcagacccagtcaggacacagcatggacatgagagtcctcgctcagctcctggggctcctgctgctctgtttcccaggtgccagatgtgacatccagatgacccagtctccatcctcactgtctgcatctgtgggagacagggtcaccttcacttgtcgggcgagtcagcgcattagcaattatttagcctggtttcagcagaaaccagggaaagcccctcagtccctgatctatgctgcattcaatttgcatagtggcgtcccatcaagattcagcgccagtggatctgggatagctttcactctcaccatcgccagcctgcagcccgaagattttgcaacttattactgccaacagtatgatgattacccgtacacttttggccaggggaccaagctggagatcaatcgaa

SEQ ID NO: 535903 - DNA, 447 bp, Homo sapiens; identical to SEQ ID NO: 535020
  misc_feature: HIJSMM301AXQG3.18.9.A09.1.454.light.4.raw

SEQ ID NO: 535904 - DNA, 495 bp, Homo sapiens; identical to SEQ ID NO: 535486
  misc_feature: HIJSMM301DE5B7.26.72.G06.1.454.light.4.raw

SEQ ID NO: 535905 - DNA, 493 bp, Homo sapiens; identical to SEQ ID NO: 535047
  misc_feature: HIJSMM301EEA5V.16.53.E09.1.454.light.4.raw

SEQ ID NO: 535906 - DNA, 447 bp, Homo sapiens; identical to SEQ ID NO: 535020
  misc_feature: HIJSMM301BHRHI.18.9.A09.1.454.light.4.raw

SEQ ID NO: 535907 - DNA, 507 bp, Homo sapiens
  misc_feature: HIJSMM301AXUIN.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggttgttcggcggagggaccaaactgaccgtcctaggtcagcccaaggctgccccctcggtccactctgtt

SEQ ID NO: 535908 - DNA, 441 bp, Homo sapiens; identical to SEQ ID NO: 534971
  misc_feature: HIJSMM301BPQLQ.11.3.A03.1.454.light.4.raw

SEQ ID NO: 535909 - DNA, 487 bp, Homo sapiens
  misc_feature: HIJSMM301DVFZJ.3.55.E11.1.454.light.4.raw
agacgcactccacgaccggtgctcgatttagcactcgcacgttgggtttggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatacaaacgaactgtggctgcaccatctgt

SEQ ID NO: 535910 - DNA, 487 bp, Homo sapiens
  misc_feature: HIJSMM301EH5CL.26.70.G04.1.454.light.4.raw
agactatactcacgaccggtgctcgatttagtgtagtgtgaagggaaagggggcgaggaatcagacccacgtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtcctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccggggggacacggctggaaactaaacgaactgtggctgcacc

SEQ ID NO: 535911 - DNA, 486 bp, Homo sapiens; identical to SEQ ID NO: 535043
  misc_feature: HIJSMM301DQFBT.46.35.D02.1.454.light.4.raw

SEQ ID NO: 535912 - DNA, 494 bp, Homo sapiens; identical to SEQ ID NO: 534992
  misc_feature: HIJSMM301CG1TR.9.1.A01.1.454.light.4.raw

SEQ ID NO: 535913 - DNA, 445 bp, Homo sapiens
  misc_feature: HIJSMM301CUD1Y.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcgggcggagggaccaagctgaccgtcctaagtcagcccaaggctgccccctcggtcactctgttcccaccctcctccgtgtctgat

SEQ ID NO: 535914 - DNA, 498 bp, Homo sapiens
  misc_feature: HIJSMM301BU6RG.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaagga

SEQ ID NO: 535915 - DNA, 510 bp, Homo sapiens
  misc_feature: HIJSMM301A6UEG.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctacttcgttcggacgggacggaacgaggcgagtacacgacgaaccgtagttggtcgtcgcgaccaactcttcgttcttcctta

SEQ ID NO: 535916 - DNA, 494 bp, Homo sapiens
  misc_feature: HIJSMM301EVS8V.41.38.D05.1.454.light.4.raw
tctatactatcacgaccggtgctcgatttagtatctgatagttgggtttgggggcaggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggaggaccaaggttgagaccaaacgaactgtggctgcaccatctgtctt

SEQ ID NO: 535917 - DNA, 486 bp, Homo sapiens
  misc_feature: HIJSMM301DREQJ.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaccca

SEQ ID NO: 535918 - DNA, 486 bp, Homo sapiens; identical to SEQ ID NO: 535043
  misc_feature: HIJSMM301BQJSW.46.35.D02.1.454.light.4.raw

SEQ ID NO: 535919 - DNA, 472 bp, Homo sapiens
  misc_feature: HIJSMM301BWI8G.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactacccctctcactttcggcgggggaccgaaggtggagatcaaacgaa

SEQ ID NO: 535920 - DNA, 482 bp, Homo sapiens
  misc_feature: HIJSMM301DHXND.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 535921 - DNA, 490 bp, Homo sapiens
  misc_feature: HIJSMM301CZIN6.52.34.D01.1.454.light.4.raw
cgcagtacgacacgaccggtgctcgatttagatcgtctgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcgagggggacgtatccctgatcgcttctcaggctccggctctgggactgagcgctacctcaccatctccagcctccagtctgaggacgagggtgactattactgtcagacgtgggacactggctagtttggggtgttcggacggagggaccaaggttgaccgtcctaggtcagcccaaggctccg

SEQ ID NO: 535922 - DNA, 481 bp, Homo sapiens
  misc_feature: HIJSMM301AZBKE.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctaccccgggcacccggagtccctgaccgattcagtggcagcgggtctgggacgagacttcactctcaccatcagcaacctgcaggctgaagatgtggcagtttattactgtcagcagtattgtgaagctccgctcactttcggcggagggaccgcggtggagatcagacgaactgtggctgcaccaatctgtctt

SEQ ID NO: 535923 - DNA, 447 bp, Homo sapiens; identical to SEQ ID NO: 535882
  misc_feature: HIJSMM301A0EQZ.18.9.A09.1.454.light.4.raw
  modified_base (429)..(429): a, c, t, g, unknown or other

SEQ ID NO: 535924 - DNA, 479 bp, Homo sapiens
  misc_feature: HIJSMM301C0RS8.3.82.H05.1.454.light.4.raw
agacgcactccacgaccggtgctcgatttagtcgagctctctcgcgggggagtcagacccacgtcaggacacagcatggacatgagggtccccgcctcagctcctggggcgtcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggagatcaaacgaactgtggctgca

SEQ ID NO: 535925 - DNA, 473 bp, Homo sapiens; identical to SEQ ID NO: 535262
  misc_feature: HIJSMM301AV974.8.67.G01.1.454.light.4.raw

SEQ ID NO: 535926 - DNA, 502 bp, Homo sapiens
  misc_feature: HIJSMM301B40OW.13.55.E11.1.454.light.4.raw
tcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaagacctacttgaattggtttcagcagaggccaggccagtctccaaggcgcctaatttataatgtttttacccgggactctggggtcccagacagattcagcggcagtgggtcaggcactgatttcacattgaaaatcaccagggtggaggctgaggatgttgggatttattactgcatgcaagctacattctggcctttcactttcggccctgggaccaagtggataccaatcgaactgtggctgcaccatctgt

SEQ ID NO: 535927 - DNA, 442 bp, Homo sapiens
  misc_feature: HIJSMM301BTM8B.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctccgacacgcgag

SEQ ID NO: 535928 - DNA, 488 bp, Homo sapiens; identical to SEQ ID NO: 535081
  misc_feature: HIJSMM301C1CM3.26.23.C01.1.454.light.4.raw

SEQ ID NO: 535929 - DNA, 486 bp, Homo sapiens; identical to SEQ ID NO: 535523
  misc_feature: HIJSMM301CFKDG.22.73.G07.1.454.light.4.raw

SEQ ID NO: 535930 - DNA, 507 bp, Homo sapiens
  misc_feature: HIJSMM301AFPF9.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcact

SEQ ID NO: 535931 - DNA, 483 bp, Homo sapiens
  misc_feature: HIJSMM301DVHU6.48.85.H08.1.454.light.4.raw
agtatacatacacgaccggtgctcgatttagtatcactcagtcgcggggtccaaacagagcttcagcaagcatagtgggaatctgcaccatgccctgggctctgctcctcctgaccctcctcactcactctgcagtgtctgtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgaccgtcctaggtcacg

SEQ ID NO: 535932 - DNA, 505 bp, Homo sapiens
  misc_feature: HIJSMM301BRY31.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagatttttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtca

SEQ ID NO: 535933 - DNA, 384 bp, Homo sapiens
  misc_feature: HIJSMM301EMHV2.41.78.H01.1.454.light.4.raw
tctatactatcacgaccggtgctcgatttagtgtgagtagtttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaaactgtggctgcaccatctgtcttcatcttcccgccatctgaatagtataga

SEQ ID NO: 535934 - DNA, 509 bp, Homo sapiens
  misc_feature: HIJSMM301BA6YU.3.37.D04.1.454.light.4.raw
agacgcactccacgaccggtgctcgatttagtagcatactgttgggtttgggggggtcgtcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaacgcccccaaactgatgatttatgatgtcaataatcggccctcaggggtttctaatcgcttctctggctccaagtctggcaacacggcctccctgaccatctctgggctccagggtgaggacgaggctgattattactgcagctcatttacaagcagcaccactcaggtcttcggaactgggactaaggtcaccgtcctaggtcagcccaaggccaaccccactgtcact

SEQ ID NO: 535935 - DNA, 504 bp, Homo sapiens
  misc_feature: HIJSMM301C4R2T.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtca

SEQ ID NO: 535936 - DNA, 490 bp, Homo sapiens
  misc_feature: HIJSMM301D1IQ7.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcat

SEQ ID NO: 535937 - DNA, 441 bp, Homo sapiens; identical to SEQ ID NO: 535074
  misc_feature: HIJSMM301D07HD.11.3.A03.1.454.light.4.raw

SEQ ID NO: 535938 - DNA, 509 bp, Homo sapiens
  misc_feature: HIJSMM301A4Q37.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgccc

SEQ ID NO: 535939 - DNA, 492 bp, Homo sapiens
  misc_feature: HIJSMM301BM7S7.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgtggc

SEQ ID NO: 535940 - DNA, 481 bp, Homo sapiens
  misc_feature: HIJSMM301BOLOK.41.68.G02.1.454.light.4.raw
tctatactatcacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctcctcccactttcggcggagggaccaagtggagatcaaacgaactgtggctgca

SEQ ID NO: 535941 - DNA, 432 bp, Homo sapiens
  misc_feature: HIJSMM301D2IYJ.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggccagggaccaagctggagatcaaacgaactgtggctgcaccatctgtcttcatcttcccgccatctgacatactcga

SEQ ID NO: 535942 - DNA, 511 bp, Homo sapiens
  misc_feature: HIJSMM301CSGS7.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccacgggaccgacacgtagaaatagagacgaactagtaggcgtgcaccactcctgtcttctactcttcccgt

SEQ ID NO: 535943 - DNA, 478 bp, Homo sapiens; identical to SEQ ID NO: 535129
  misc_feature: HIJSMM301BRG7Q.11.11.A11.1.454.light.4.raw

SEQ ID NO: 535944 - DNA, 494 bp, Homo sapiens
  misc_feature: HIJSMM301BK4IG.40.80.H03.1.454.light.4.raw
tctagcgactcacgaccggtgctcgatttagctgtgcgtcgaagggaaaggggactgctcagttaggacccagagggaaccatggaagccccagctcagcttctcttcctcctgctactctggctcccagataccgccggagaaattgtgttgacacagtctccagccaccctgtctttatctccaggggaaagagccatcctctcctgcagggccagtcagaatattgatacatacttagcctggtaccagcagaaacctggcctggctcccagggtcctcatccatgatgcctcccacagggccactggcatcccacacaggttcagtggcagtgggtctgggacagacttcagtctcaccatcagcagcctagagcctgaggattttgcaatttatttctgtcaacagcgtagcacctggccccgggtcaccttcggccaagggacacgactggacatgaaacgaactgtggctgcaccatctgtcttcat

SEQ ID NO: 535945 - DNA, 511 bp, Homo sapiens
  misc_feature: HIJSMM301BDNDF.43.23.C01.1.454.light.4.raw
tgtgagtagtcacgaccggtgctcgatttagtacacgtgattagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcact

SEQ ID NO: 535946 - DNA, 489 bp, Homo sapiens
  misc_feature: HIJSMM301AVSNI.49.33.C11.1.454.light.4.raw
agtcgagagacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggagatcaaacgaactgtggctgcaccat

SEQ ID NO: 535947 - DNA, 503 bp, Homo sapiens
  misc_feature: HIJSMM301CTSKR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtcaaacgaactgtggctgcaccatctgtcttcatcttccccg

SEQ ID NO: 535948 - DNA, 463 bp, Homo sapiens; identical to SEQ ID NO: 535008
  misc_feature: HIJSMM301D5F70.10.9.A09.1.454.light.4.raw

SEQ ID NO: 535949 - DNA, 484 bp, Homo sapiens; identical to SEQ ID NO: 535400
  misc_feature: HIJSMM301D5X62.46.26.C04.1.454.light.4.raw

SEQ ID NO: 535950 - DNA, 447 bp, Homo sapiens
  misc_feature: HIJSMM301BZRMJ.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaggtcagcccaaggccaaccccactgtcactctgttcccgccctcctccatactcgta

SEQ ID NO: 535951 - DNA, 485 bp, Homo sapiens
  misc_feature: HIJSMM301A97G6.46.35.D02.1.454.light.4.raw
actagcagtacacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgataactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 535952 - DNA, 486 bp, Homo sapiens; identical to SEQ ID NO: 535043
  misc_feature: HIJSMM301CODIJ.46.35.D02.1.454.light.4.raw

SEQ ID NO: 535953 - DNA, 500 bp, Homo sapiens
  misc_feature: HIJSMM301AT9XW.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgtaacttactactgtcaacagagttatgatacccccgtggacgttcggccaggggaccaaggtggagatcaaacgaaactgtggctgcaccatctgtcttcatcttcccgccta

SEQ ID NO: 535954 - DNA, 503 bp, Homo sapiens
  misc_feature: HIJSMM301AESSU.17.27.C05.1.454.light.4.raw
cgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctgccccctcggtcta

SEQ ID NO: 535955 - DNA, 482 bp, Homo sapiens
  misc_feature: HIJSMM301BVXZV.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggaggaccaaggtgagatcaaacgaa

SEQ ID NO: 535956 - DNA, 494 bp, Homo sapiens; identical to SEQ ID NO: 534992
  misc_feature: HIJSMM301ARVR9.9.1.A01.1.454.light.4.raw

SEQ ID NO: 535957 - DNA, 485 bp, Homo sapiens
  misc_feature: HIJSMM301C6VIX.41.10.A10.1.454.light.4.raw
  modified_base (422)..(422): a, c, t, g, unknown or other
tctatactatcacgaccggtgctcgatttagcgtcgatctcagggggcatgagcaagactgacaagtcaaggcaggaagatgttgccatcacaactcattgggtttctgctgctctgggttccagcctccaggggtgaaattgtgctgactcagtctccaggctttcagtctgtgactccaaaggagaaagtcaccatcacctgccgggccagtcagagcattgatagtgatttacactggtaccagcagaaaccaaatcagtctccaaagctcctcatcaagtattcttcccagtccatctcaggggtcccctcgaggttcagtggcagtggatctgggacagatttcaccctcaccatcagtagcctggaagctgaagatgctgcaacgtattactgtcatcagagtcgtagtttacctnaaacgttcggccaagggaccaaggtggaaatcaaacgactgtggctgcaccatctgtcttcat

SEQ ID NO: 535958 - DNA, 505 bp, Homo sapiens
  misc_feature: HIJSMM301DOIVN.4.57.F02.1.454.light.4.raw
  modified_base (494)..(494): a, c, t, g, unknown or other
  modified_base (501)..(501): a, c, t, g, unknown or other
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccncatcacnctcg

SEQ ID NO: 535959 - DNA, 489 bp, Homo sapiens; identical to SEQ ID NO: 535386
  misc_feature: HIJSMM301DWER0.12.51.E07.1.454.light.4.raw

SEQ ID NO: 535960 - DNA, 505 bp, Homo sapiens
  misc_feature: HIJSMM301CT3QC.9.12.B01.1.454.light.4.raw
tgatacgtctcacgaccggtgctcgatttagtagtgtagattccgcggggacaacaggcaggcaggggcgagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccacggaccgaaggtggaatacaaacgaaacctgtggctgcaccatctgtcttctatcttccccg

SEQ ID NO: 535961 - DNA, 441 bp, Homo sapiens; identical to SEQ ID NO: 535074
  misc_feature: HIJSMM301ATU4S.11.3.A03.1.454.light.4.raw

SEQ ID NO: 535962 - DNA, 482 bp, Homo sapiens
  misc_feature: HIJSMM301CIAXJ.47.62.F07.1.454.light.4.raw
  modified_base (413)..(413): a, c, t, g, unknown or other
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacngtatcataatctccccactttcggcctggaccaagtggatatcaaacgaactgtggctgcaccatctgt

SEQ ID NO: 535963 - DNA, 485 bp, Homo sapiens
  misc_feature: HIJSMM301BHO8L.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcat

SEQ ID NO: 535964 - DNA, 495 bp, Homo sapiens
  misc_feature: HIJSMM301DNGVZ.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctcggtcactctgttccca

SEQ ID NO: 535965 - DNA, 494 bp, Homo sapiens; identical to SEQ ID NO: 534994
  misc_feature: HIJSMM301BVWBS.27.78.H01.1.454.light.4.raw

SEQ ID NO: 535966 - DNA, 403 bp, Homo sapiens
  misc_feature: HIJSMM301A3OOZ.49.53.E09.1.454.light.4.raw
  modified_base (385)..(385): a, c, t, g, unknown or other
agtcgagagacacgaccggtgctcgatttagagagagtgtgttgggtttggggagttggtagatgcccctctgggagagatccccaggggtgacagccatggaccctggaagggcctgggctagggacagggaccagagccagtccagggagaggacagagccaatggactggggtgtactgtaacagccctgctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctgttcccnccctcctctctctcgact

SEQ ID NO: 535967 - DNA, 490 bp, Homo sapiens
  misc_feature: HIJSMM301BKUKU.52.53.E09.1.454.light.4.raw
cgcagtacgacacgaccggtgctcgatttagagagagtgtgttgggtttggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttggggtgttcggcggagggaccaagttgaccgtcctaggtcagcccaaggctcgcccccc

SEQ ID NO: 535968 - DNA, 511 bp, Homo sapiens
  misc_feature: HIJSMM301BULOJ.48.37.D04.1.454.light.4.raw
agtatacatacacgaccggtgctcgatttagtagcatactgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccaatgacaatcatgcgattttcggcggagggaccaagctgaccgtcctgggtcagcccaaggctgccccctcggtcactctgttccccg

SEQ ID NO: 535969 - DNA, 468 bp, Homo sapiens
  misc_feature: HIJSMM301AOWSS.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggaggaccaaggtggagatcaaacgaa

SEQ ID NO: 535970 - DNA, 492 bp, Homo sapiens
  misc_feature: HIJSMM301AN6GX.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcgtcggagggaccgacggtggagatcaaacgaacctagtggctgtcgaccactctcgtcttcta

SEQ ID NO: 535971 - DNA, 443 bp, Homo sapiens
  misc_feature: HIJSMM301B05O5.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgaccgcgag

SEQ ID NO: 535972 - DNA, 492 bp, Homo sapiens
  misc_feature: HIJSMM301BAAQB.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtaggacgatcaagcgaactgtggctgcaccatctgt

SEQ ID NO: 535973 - DNA, 493 bp, Homo sapiens
  misc_feature: HIJSMM301DOV0D.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttccccgccat

SEQ ID NO: 535974 - DNA, 498 bp, Homo sapiens
  misc_feature: HIJSMM301BSKHP.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtggctgcacc

SEQ ID NO: 535975 - DNA, 480 bp, Homo sapiens
  misc_feature: HIJSMM301BC13F.51.60.F05.1.454.light.4.raw
cgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagcccaaggctcg

SEQ ID NO: 535976 - DNA, 510 bp, Homo sapiens
  misc_feature: HIJSMM301EHKFV.13.53.E09.1.454.light.4.raw
tcacgtactacacgaccggtgctcgatttagagagagtgtgttgggtttggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggccaggaccgaaggtaggaaagtacaagcgaactagtggctgcaccatctgtcttctacttttccccg

SEQ ID NO: 535977 - DNA, 503 bp, Homo sapiens
  misc_feature: HIJSMM301DAMLN.13.11.A11.1.454.light.4.raw
tcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggtaccaacagaaaccaggacagcctccgaagttactctttactggcgtctacccggaatccgggtcctgaccgattcagtggcagcgggtctgggacagatttcactctcaccatcagcagccttcaggctgaagatgtggctagtttattactgtcagcaatattatatctctcctcctcggacgtcgtccaaggaaccgaggtaggaaagtacaaacgaactagtggctgcaccatctgtcttctatccttcccgtcccact

SEQ ID NO: 535978 - DNA, 422 bp, Homo sapiens; identical to SEQ ID NO: 447881
  misc_feature: HIJSMM301A4HUB.9.34.D01.1.454.light.4.raw

SEQ ID NO: 535979 - DNA, 511 bp, Homo sapiens
  misc_feature: HIJSMM301BDKQ0.15.76.G10.1.454.light.4.raw
tctacgtagccacgaccggtgctcgatttagtcactcatacagggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctctcgctacg

SEQ ID NO: 535980 - DNA, 494 bp, Homo sapiens
  misc_feature: HIJSMM301AE0IO.17.26.C04.1.454.light.4.raw
cgtagactagcacgaccggtgctcgatttagtctagcgactttgggtttgggggtcgagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctccggctcactttcgtcggagggaccgaaggtaggaggatcaaacgaaacctagtggctgcaccact

SEQ ID NO: 535981 - DNA, 516 bp, Homo sapiens
  misc_feature: HIJSMM301AUTVJ.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtggggaagcaacattggaagcaaaatgtgcactggtacatgcagaggccaggccaggcccctgtttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgttcccacctccctcgacgt

SEQ ID NO: 535982 - DNA, 494 bp, Homo sapiens
  misc_feature: HIJSMM301BJ7MJ.26.80.H03.1.454.light.4.raw
  modified_base (350)..(350): a, c, t, g, unknown or other
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaactaatggtctcctacctggaatgccacctcgactcagtggcaacaaatatggaacagtttttacccncacaactcatatcacagaatctgaggatgctgcattttactcggtctacaacatgataatttccctccgtggacgttcggccaagggaccaaggagcaaatcaaacgaactgtggctgcaccatctgtcttcatcttccgccat

SEQ ID NO: 535983 - DNA, 478 bp, Homo sapiens
  misc_feature: HIJSMM301CPL3R.21.25.C03.1.454.light.4.raw
tcgtcgctcgcacgaccggtgctcgatttagtagtgtagatttgggttggggctgtcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggacc

SEQ ID NO: 535984 - DNA, 504 bp, Homo sapiens; identical to SEQ ID NO: 535077
  misc_feature: HIJSMM301D4GGP.8.28.C06.1.454.light.4.raw

SEQ ID NO: 535985 - DNA, 485 bp, Homo sapiens
  misc_feature: HIJSMM301D2ELD.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgccctcctcgctacgtaga

SEQ ID NO: 535986 - DNA, 444 bp, Homo sapiens; identical to SEQ ID NO: 535411
  misc_feature: HIJSMM301AYGT4.8.73.G07.1.454.light.4.raw

SEQ ID NO: 535987 - DNA, 505 bp, Homo sapiens
  misc_feature: HIJSMM301CHHQ8.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcaccatctgt

SEQ ID NO: 535988 - DNA, 506 bp, Homo sapiens
  misc_feature: HIJSMM301AYRR7.41.2.A02.1.454.light.4.raw
tctatactatcacgaccggtgctcgatttagactcatctacaggggagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcatggtctcccccttacgtttggtcggagggaccgaacggttaggtagaatcaaaccgaaaactcgtggcgtgcaccaactctgtcttctatcttccccgt

SEQ ID NO: 535989 - DNA, 504 bp, Homo sapiens; identical to SEQ ID NO: 535561
  misc_feature: HIJSMM301AJ8OI.4.57.F02.1.454.light.4.raw

SEQ ID NO: 535990 - DNA, 488 bp, Homo sapiens
  misc_feature: HIJSMM301EFA28.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccaaggtggagatcaaacgaa

SEQ ID NO: 535991 - DNA, 497 bp, Homo sapiens
  misc_feature: HIJSMM301D14C1.48.31.C09.1.454.light.4.raw
agtatacatacacgaccggtgctcgatttagacgtctcatcaaggaaggaagggggcaggagtcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcggccaagggaccaaggtggaagtcagacgaactgtggctgcaccatctgtctt

SEQ ID NO: 535992 - DNA, 472 bp, Homo sapiens
  misc_feature: HIJSMM301DR7VQ.11.76.G10.1.454.light.4.raw
cgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccaggggaccaggctggagat

SEQ ID NO: 535993 - DNA, 481 bp, Homo sapiens
  misc_feature: HIJSMM301BZPVF.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggacc

SEQ ID NO: 535994 - DNA, 463 bp, Homo sapiens; identical to SEQ ID NO: 535008
  misc_feature: HIJSMM301A7QVF.10.9.A09.1.454.light.4.raw

SEQ ID NO: 535995 - DNA, 352 bp, Homo sapiens
  misc_feature: HIJSMM301B1IC6.4.67.G01.1.454.light.4.raw
agcactgtagcacgaccggtgctcgatttagagtatacatattggttactatgactttgtctcgtggtaccaacaacacccaggcaaagcccccaaactcataatttatggtgtcactaagcggccctcaggggtccctgatcgcttctctggctccaagtctggcaacatggcctccctgaccatctctgggctccaggctgaggatgaggctgattactactgctgctcctttgcaggcgcctctgtctcaggcagctatgtcttcggaactgggaccgaagtgaccgtcctgggtcagcccaaggccaaccccactgtcactctgttcccgccctcctcctacagtgct

SEQ ID NO: 535996 - DNA, 475 bp, Homo sapiens
  misc_feature: HIJSMM301C2O2W.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatcccagatgacccagtcgtccagtcctcccgtgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcatacccctctcactttcggcggggggaccaaggtggagatcaacgaa

SEQ ID NO: 535997 - DNA, 467 bp, Homo sapiens
  misc_feature: HIJSMM301CB15G.5.36.D03.1.454.light.4.raw
atcagacacgcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaa

SEQ ID NO: 535998 - DNA, 484 bp, Homo sapiens
  misc_feature: HIJSMM301DPB1L.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaa

SEQ ID NO: 535999 - DNA, 480 bp, Homo sapiens
  misc_feature: HIJSMM301CN8VZ.4.27.C05.1.454.light.4.raw
agcactgtagcacgaccggtgctcgatttagacgcgatcgaagggtttggggatcaggactcctcagttcaccttctcacaatgaggctccctgctcagctcctgggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggccaggggaccaggctggagatcaaacgaa

SEQ ID NO: 536000 - DNA, 491 bp, Homo sapiens
  misc_feature: HIJSMM301CT3VX.48.1.A01.1.454.light.4.raw
agtatacatacacgaccggtgctcgatttagacgtctcatcagggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcat

SEQ ID NO: 536001 - DNA, 487 bp, Homo sapiens
  misc_feature: HIJSMM301APEHS.40.20.B09.1.454.light.4.raw
tctagcgactcacgaccggtgctcgatttagtgtagtgtgaagggggccgtcagaagccgcatcggaggtgcctcagccatggcatggatccctctcttcctcggcgtccttgcttactgcacaggatccgtggcctcctctgagttgactcagccaccctcagtgtccgtgtccccggacagacagccagcatcacgtgctcaggagatgatttgaacaataaacatgcttgttggtatcaacagaaaccaggccagtcccctgttctggtcatctttgaggattcaaagcggccctcagggatccctgagcgattctctggctccaagtctgcgctcacagccactctgaccatcagcgggacccagcctatggatgaggctgactattattgtcagtcgtgggacagcagcacctcttcctatgtcttcggaactgggacccaggtcaccgtcctcggtcagcccaaggccaaccccactgtca

SEQ ID NO: 536002 - DNA, 503 bp, Homo sapiens
  misc_feature: HIJSMM301EGG0I.51.23.C01.1.454.light.4.raw
cgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagatcaaacgaactgtggctgcaccatctgtcttcatcttcccgccat

SEQ ID NO: 536003 - DNA, 501 bp, Homo sapiens; identical to SEQ ID NO: 535873
  misc_feature: HIJSMM301AT55E.17.27.C05.1.454.light.4.raw

SEQ ID NO: 536004 - DNA, 496 bp, Homo sapiens
  misc_feature: HIJSMM301B67P5.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggaggatcaaacgaactgtggctgcaccatctgtcttctat

SEQ ID NO: 536005 - DNA, 518 bp, Homo sapiens
  misc_feature: HIJSMM301BV7Q6.8.34.D01.1.454.light.4.raw
ctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggcccgactttcggtcccgtcgggtaccgaaaacgtgggatattcaaacgaactgtggctgcaccatctgtcttcta

SEQ ID NO: 536006 - DNA, 487 bp, Homo sapiens
  misc_feature: HIJSMM301AQN47.4.64.F09.1.454.light.4.raw
agcactgtagcacgaccggtgctcgatttagcgcgtatacagggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgcaacttacttttgtcaacagactaactcattccctcgcagttttggccaggggaccaaggtggagatcaaacgaactgtggctgcaccatctgtcttcatt

SEQ ID NO: 536007 - DNA, 493 bp, Homo sapiens
  misc_feature: HIJSMM301BZ32Q.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcacatctgtctt

SEQ ID NO: 536008 - DNA, 486 bp, Homo sapiens
  misc_feature: HIJSMM301CN0CV.52.83.H06.1.454.light.4.raw
cgcagtacgacacgaccggtgctcgatttagatcacgtgcgtcgcggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcggcggagggaccaaggtcgagatcaaacgaactgtggctgcaccatctgtcttcatt

SEQ ID NO: 536009 - DNA, 477 bp, Homo sapiens
  misc_feature: HIJSMM301AHAOB.13.76.G10.1.454.light.4.raw
tcacgtactacacgaccggtgctcgatttagtcactcatacagggggccgtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccc

SEQ ID NO: 536010 - DNA, 492 bp, Homo sapiens
  misc_feature: HIJSMM301ANUK0.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaagtggatttcagacgaactgtggctgcaccatctgtcttcta

SEQ ID NO: 536011 - DNA, 447 bp, Homo sapiens; identical to SEQ ID NO: 535201
  misc_feature: HIJSMM301C3HZW.18.9.A09.1.454.light.4.raw

SEQ ID NO: 536012 - DNA, 486 bp, Homo sapiens
  misc_feature: HIJSMM301B0SS8.12.31.C09.1.454.light.4.raw
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtggttcccgtcaaggttcactggccgtggatcagggacagaatttactctcaccatcagtagtctacagcctgaagatattgctacttattactgtcagcagagttaccgcgctcccatcactttcggccaaggacacgaccgcagattggacgaactgtggctgcacc

SEQ ID NO: 536013 - DNA, 489 bp, Homo sapiens
  misc_feature: HIJSMM301ANQTH.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtggctgcaccatctgtt

SEQ ID NO: 536014 - DNA, 490 bp, Homo sapiens
  misc_feature: HIJSMM301DDW07.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtgaggctgaggatgttgggttgttcctccatgcaaggtacacactggccttttggccaggggaccaacctggagatcaaatgaactgtggctgcaccatctgtctt

SEQ ID NO: 536015 - DNA, 463 bp, Homo sapiens
  misc_feature: HIJSMM301BB40F.4.29.C07.1.454.light.4.raw
agcactgtagcacgaccggtgctcgatttagagtgctacgaagggaaagggggaagagctgctcagttaggacccagagggaaccatggaaaccccagcgcagcttctcttcctcctgctactctggctccctggggaaagagccaccctctcctgcagggccagtcagaatgttagcagcagattcttagcctggtatcagcagagacgtggccaggctcccaggctcatcatctatggtgcatccagcagggccactggcatcccagacaggttcagtggcagtgggtctgggacagacttcactctcaccatcagcgacctggagcctgaagattttgcagtgtattactgtcagcagtatggtagcgcacggacgttcggccaaggggccagggtggaaatcaaacgaactgtggctgcaccatctgtcttcatcttcccgccatctgactacagtgct

SEQ ID NO: 536016 - DNA, 504 bp, Homo sapiens
  misc_feature: HIJSMM301CGPW5.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattttgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcatcttccg

SEQ ID NO: 536017 - DNA, 493 bp, Homo sapiens
  misc_feature: HIJSMM301A8SXM.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcgggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgcagtttattactgtcagcagtatggtacttcacaaaccttcggccaggggacacgactggagattaagcgaactgtggctgcaccatctgtctt

SEQ ID NO: 536018 - DNA, 465 bp, Homo sapiens
  misc_feature: HIJSMM301CP29P.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccgaaggtaggaatacaaacgaactgtggctgcaccatctgtcttcatcttcccgccatctgatcgtagcact

SEQ ID NO: 536019 - DNA, 499 bp, Homo sapiens
  misc_feature: HIJSMM301EZVPH.3.36.D03.1.454.light.4.raw
agacgcactccacgaccggtgctcgatttagctgcgtcacgatctctcttgggggaggaactgctcagttaggacccacgagggaaccatggaaaccccacgcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggaccaggttcagaggcagtggggtatgggacagacttcactctcaccatcagcagactggagcctggagattttgcagtttattactgtcagcagtatggtacttcacaaaccttcggccaggggacgacgactggagattaagcgaactgtggctgcaccatctgtctt

SEQ ID NO: 536020 - DNA, 495 bp, Homo sapiens
  misc_feature: HIJSMM301CB6LP.41.38.D05.1.454.light.4.raw
tctatactatcacgaccggtgctcgatttagtatctgatagttgggttggggaggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcaccatctgtcttcta

SEQ ID NO: 536021 - DNA, 503 bp, Homo sapiens
  misc_feature: HIJSMM301B6SHN.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttccgc

SEQ ID NO: 536022 - DNA, 504 bp, Homo sapiens; identical to SEQ ID NO: 535077
  misc_feature: HIJSMM301D5OLH.8.28.C06.1.454.light.4.raw

SEQ ID NO: 536023 - DNA, 486 bp, Homo sapiens; identical to SEQ ID NO: 535043
  misc_feature: HIJSMM301DYOXI.46.35.D02.1.454.light.4.raw

SEQ ID NO: 536024 - DNA, 497 bp, Homo sapiens
  misc_feature: HIJSMM301EHLDB.52.55.E11.1.454.light.4.raw
cgcagtacgacacgaccggtgctcgatttagcactcgcacgttgggtttgggggaacgtgctcagttaggacccacgagggaaccatggaagccccacgctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcacatcagtggcctcgagcctgaagatttgcagtttattactgtcagcagcgtagccactggctctctttcggcggagggaccaaggttgagatcaacgaactgtggctgcaccatctgtcttcatcttcccg

SEQ ID NO: 536025 - DNA, 487 bp, Homo sapiens
  misc_feature: HIJSMM301AK5DH.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaa

SEQ ID NO: 536026 - DNA, 500 bp, Homo sapiens
  misc_feature: HIJSMM301DHF56.52.36.D03.1.454.light.4.raw
  modified_base (497)..(497): a, c, t, g, unknown or other
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacaattggtgttcggcggagggaccaagctgaccgtcctacgtcagcccaaggctgccccctcggtcactcngtt

SEQ ID NO: 536027 - DNA, 500 bp, Homo sapiens
  misc_feature: HIJSMM301AOI8Y.4.59.F04.1.454.light.4.raw
agcactgtagcacgaccggtgctcgatttagtacacacacttagggattggggaggaactgctcagttaggacccacgacggaaccatggaagccccacgcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaagggaccgaaggtaggaatacaaacgaaactgtggctgcaccatctgtctt

SEQ ID NO: 536028 - DNA, 496 bp, Homo sapiens
  misc_feature: HIJSMM301EOE3G.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctcgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccc

SEQ ID NO: 536029 - DNA, 444 bp, Homo sapiens; identical to SEQ ID NO: 534993
  misc_feature: HIJSMM301A4CUP.5.9.A09.1.454.light.4.raw

SEQ ID NO: 536030 - DNA, 499 bp, Homo sapiens
  misc_feature: HIJSMM301CT9UT.48.23.C01.1.454.light.4.raw
agtatacatacacgaccggtgctcgatttagtacacgtgattagggattggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 536031 - DNA, 487 bp, Homo sapiens
  misc_feature: HIJSMM301D4Z5T.5.39.D06.1.454.light.4.raw
atcagacacgcacgaccggtgctcgatttagtgacatctcgcagttctttggggagtcagactcagtcaggacacagcatggacatgagggtccccgctcagctcctggggctcctgctgctctggctcccaggtgccgtagggtgacgattccgagacgtgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaactgtggctgcaccat

SEQ ID NO: 536032 - DNA, 493 bp, Homo sapiens
  misc_feature: HIJSMM301AIZFK.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcat

SEQ ID NO: 536033 - DNA, 496 bp, Homo sapiens
  misc_feature: HIJSMM301EIFQB.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctggggacagacttcactctcaccatcagcagactggagtctgaagattttgcagtgtattattgtcagcaatatggtaggtcacctgggacttttggccaggggaccaagctggagatcaaacgaactgtggctgcaccatctgtctt

SEQ ID NO: 536034 - DNA, 446 bp, Homo sapiens
  misc_feature: HIJSMM301CW67C.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccaccctcctccatactcgta

SEQ ID NO: 536035 - DNA, 496 bp, Homo sapiens; identical to SEQ ID NO: 535109
  misc_feature: HIJSMM301CDEKS.16.78.H01.1.454.light.4.raw

SEQ ID NO: 536036 - DNA, 448 bp, Homo sapiens
  misc_feature: HIJSMM301BKPSG.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 536037 - DNA, 483 bp, Homo sapiens
  misc_feature: HIJSMM301AHNUB.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccgaaggtcgaaatgagacgaactgtggctgcaccat

SEQ ID NO: 536038 - DNA, 506 bp, Homo sapiens
  misc_feature: HIJSMM301DTSGR.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaagtggatatcaaacgaactgtggctgcaccatctgtctt

SEQ ID NO: 536039 - DNA, 471 bp, Homo sapiens
  misc_feature: HIJSMM301ALBEA.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctctccgagtgccacttttggcggggggaccaaggtggacatcaaacgaa

SEQ ID NO: 536040 - DNA, 485 bp, Homo sapiens
  misc_feature: HIJSMM301DXGPU.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctcgctacgtaga

SEQ ID NO: 536041 - DNA, 500 bp, Homo sapiens
  misc_feature: HIJSMM301A7WNM.14.55.E11.1.454.light.4.raw
  modified_base (457)..(457): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtaccccctcctctacgttcggcggacggacgaggcgganatacagacgtaacgtggtgctcgaccacctatcgttcttctta

SEQ ID NO: 536042 - DNA, 496 bp, Homo sapiens
  misc_feature: HIJSMM301DHK47.14.55.E11.1.454.light.4.raw
  modified_base (478)..(478): a, c, t, g, unknown or other
  modified_base (487)..(487): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctactcgttcggacggacggaacgaggaggatcacgagaacgtatggtcgcncgccaactntctcgttct

SEQ ID NO: 536043 - DNA, 489 bp, Homo sapiens
  misc_feature: HIJSMM301A89NE.49.53.E09.1.454.light.4.raw
agtcgagagacacgaccggtgctcgatttagagagagtgtgttgggtttgggctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggagatcaaacgaa

SEQ ID NO: 536044 - DNA, 489 bp, Homo sapiens
  misc_feature: HIJSMM301C4LMY.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaaggaccaaggtggaagtcaacgaactgtggctgcaccatctgtctt

SEQ ID NO: 536045 - DNA, 506 bp, Homo sapiens
  misc_feature: HIJSMM301A6VSU.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaagtacaaacgaactagtggctgcaccatctgtcttcatcttccccg

SEQ ID NO: 536046 - DNA, 511 bp, Homo sapiens
  misc_feature: HIJSMM301BNSUQ.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccaggaccgaacggtaggaagtacgaacgaactagtggcgtgcgaccactctgtcttctatcttccgtcccact

SEQ ID NO: 536047 - DNA, 509 bp, Homo sapiens
  misc_feature: HIJSMM301CLPCW.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttccca

SEQ ID NO: 536048 - DNA, 420 bp, Homo sapiens
  misc_feature: HIJSMM301BVAOH.18.78.H01.1.454.light.4.raw
tacgagtatgcacgaccggtgctcgatttagtgtgagtagtttgggtttggggcttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 536049 - DNA, 472 bp, Homo sapiens
  misc_feature: HIJSMM301A5CIT.51.34.D01.1.454.light.4.raw
cgatcgtatacacgaccggtgctcgatttagatcgtctgtgttgggtttggggcagaagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcgggggacggaagtggagatcagacg

SEQ ID NO: 536050 - DNA, 479 bp, Homo sapiens
  misc_feature: HIJSMM301B3MDA.5.73.G07.1.454.light.4.raw
atcagacacgcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccgccctgtctgtgtctccaggggaaagagcctccctctcgtgcagggccagtcagagtgttagaatcaacttagcctggtaccagcagaaacctggccagcctcccaggcccctcatctatgctgcatccgccagggccactggtatcccagccaggttcagtggcagtgggtctgggacagacttcactctcaccatcagcagcctgcagtctgaagattttgcagtttattactgtcagcagtatgatgactggcctcagacgttcggccaagggaccaaggtggaagtcaaacgaactgtggctgcaccat

SEQ ID NO: 536051 - DNA, 480 bp, Homo sapiens
  misc_feature: HIJSMM301EIWEW.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactagtggctgcaccatct

SEQ ID NO: 536052 - DNA, 498 bp, Homo sapiens
  misc_feature: HIJSMM301AICKK.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggtccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctggaagctgaagatgctgcaactttattactgtcatcagagtacttactttacctcaagtgatcaccttcggccaagggacacgactggagattaaacgaactgtggcgtgcaccactctgtctt

SEQ ID NO: 536053 - DNA, 460 bp, Homo sapiens
  misc_feature: HIJSMM301CCH3J.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccaccctcctcacgcgtatgt

SEQ ID NO: 536054 - DNA, 484 bp, Homo sapiens; identical to SEQ ID NO: 535441
  misc_feature: HIJSMM301CKHQR.26.60.F05.1.454.light.4.raw

SEQ ID NO: 536055 - DNA, 495 bp, Homo sapiens
  misc_feature: HIJSMM301AW2P1.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaactgtggctgca

SEQ ID NO: 536056 - DNA, 488 bp, Homo sapiens
  misc_feature: HIJSMM301CB26Y.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtgggtcccatcaaggttcagcggcagtggatctgggacagatttcactctcactatcagcagcctgcagcctgaagattttggaacttattattgtcaacagggtaacagtttcccgctcaccttcggcggagggaccaaggtggagatgaaaagaactgtggctgcaccat

SEQ ID NO: 536057 - DNA, 493 bp, Homo sapiens
  misc_feature: HIJSMM301C7X4Y.27.78.H01.1.454.light.4.raw
  modified_base (398)..(398): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttnttactgtcatcagagtactactttacctcaagtgatcaccttcggccaagggacacgactggagattaacgaactgtggctgcaccatctgtctt

SEQ ID NO: 536058 - DNA, 507 bp, Homo sapiens
  misc_feature: HIJSMM301CCZV9.12.50.E06.1.454.light.4.raw
  modified_base (503)..(503): a, c, t, g, unknown or other
atacgacgtacacgaccggtgctcgatttagatctactgacaacacacaagggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaagagtcaccctctcctgcagggccagtcagagtgttagcggcaactacttagcctggtaccaacagaaacctggccaggctcccaggctcgtcatctatggtgcatccagcagggccactggcatcccagacaggttcagtggcagtgggtctgggacagacttcactctcaccatcagtagactggagcctgaagattttgcagtttattactgtcagcagtatgggggctcacgtcgattcactttcgccgtcggacgaacgtaagatagtcaacgaactagtggtcgtgcaccactcttntctt

SEQ ID NO: 536059 - DNA, 505 bp, Homo sapiens; identical to SEQ ID NO: 535503
  misc_feature: HIJSMM301DDPS3.8.28.C06.1.454.light.4.raw

SEQ ID NO: 536060 - DNA, 493 bp, Homo sapiens
  misc_feature: HIJSMM301EDT2V.48.1.A01.1.454.light.4.raw
agtatacatacacgaccggtgctcgatttagacgtctcatcagggggcgaggagtcagacccacgtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcat

SEQ ID NO: 536061 - DNA, 500 bp, Homo sapiens
  misc_feature: HIJSMM301BG2I8.41.42.D09.1.454.light.4.raw
tctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagagccaccctctcctgcagggccagtcagagtcttagcggcaccttagcctggtaccagcagaaacctggccaggctcccaggctcctcatctatggtacatccaccagggtcactggtgttccagccaggttcagtggcagtgggtccgggacagagttcactctcaccatcagcagcctgcagtctgaagattttgcgatttattactgtcaccactataataattggccctccgcgtggacgttcggccaaggaccaaggtggaaatcaaacgaactgtggctgcaccatctgtcttcta

SEQ ID NO: 536062 - DNA, 508 bp, Homo sapiens
  misc_feature: HIJSMM301EUT4Z.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgcc

SEQ ID NO: 536063 - DNA, 496 bp, Homo sapiens
  misc_feature: HIJSMM301DQKC5.5.49.E05.1.454.light.4.raw
atcagacacgcacgaccggtgctcgatttagagcgactagcaacacacaaagggggctgctcagttaggacccagagggaaccatggaaaccccagcgcagcttctcttcctcctgctactctggctcccagataccgtcggagaagtcgtgttgacgcagtctccagacaccctgtctttgtctccaggggagagagccaccctctcctgcagggccagtgagagtcttggcggcagtcacttagcctggtaccagcaaaaacctggccaggctccccggctcctcatctatggtgcgtccaacagggccactgacaccccacgcagattcagcggcagtgggtctgggacagacttcactctcaccatcctcagagtggagcctgaagattttgcagtatattactgtcagcagtatggcttctcacctcacaatttcggcggcgggaccaaggtggagaccaaacgaactgtggctgcaccatctgtcttcta

SEQ ID NO: 536064 - DNA, 519 bp, Homo sapiens
  misc_feature: HIJSMM301B8NN0.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcacttctcaccatcaacagactgcagcctgaagatattgcagtttactactgtcagcagtatgttacgtccccgtggacgttcggccaagggaccaaggtggcaatcaaccgaactgtggctgcaccatctgtcttcatcttccccg

SEQ ID NO: 536065 - DNA, 453 bp, Homo sapiens
  misc_feature: HIJSMM301CW02R.18.78.H01.1.454.light.4.raw
tacgagtatgcacgaccggtgctcgatttagtgtgagtagtttgggtttggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccaccctcctccatactcgta

SEQ ID NO: 536066 - DNA, 486 bp, Homo sapiens; identical to SEQ ID NO: 535043
  misc_feature: HIJSMM301CHW8B.46.35.D02.1.454.light.4.raw

SEQ ID NO: 536067 - DNA, 504 bp, Homo sapiens; identical to SEQ ID NO: 535561
  misc_feature: HIJSMM301EBQMC.4.57.F02.1.454.light.4.raw

SEQ ID NO: 536068 - DNA, 492 bp, Homo sapiens
  misc_feature: HIJSMM301APLTH.15.49.E05.1.454.light.4.raw
tctacgtagccacgaccggtgctcgatttagagcgactagcaacacacaaagggggaggaactgctcagttaggacccacgacggaaccatggaagccccacgcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaaatacaaacgaactagtggctgcaccat

SEQ ID NO: 536069 - DNA, 491 bp, Homo sapiens
  misc_feature: HIJSMM301B38S1.21.27.C05.1.454.light.4.raw
tcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacggaccaaggtggaatcaacgaactgtggctgcaccatctgtctt

SEQ ID NO: 536070 - DNA, 445 bp, Homo sapiens
  misc_feature: HIJSMM301DJBBM.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccacccctcctccgtgtctgat

SEQ ID NO: 536071 - DNA, 377 bp, Homo sapiens
  misc_feature: HIJSMM301BBYPT.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 536072 - DNA, 497 bp, Homo sapiens
  misc_feature: HIJSMM301D17YT.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctggggacagagttcactctcaccatcagcagcctgcagtctgaagattttgcggtttattactgtcagcagtataataactggcctccacggtacacttttggccaggggaccaagctggagatcaaacgaactgtggctgcaccatctgt

SEQ ID NO: 536073 - DNA, 488 bp, Homo sapiens
  misc_feature: HIJSMM301C8VG7.15.1.A01.1.454.light.4.raw
tctacgtagccacgaccggtgctcgatttagacgtctcatcagggccgtgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggcctgccccctcggtcactctgttcccgaccctcctcgctacgtaga

SEQ ID NO: 536074 - DNA, 416 bp, Homo sapiens
  misc_feature: HIJSMM301DBSE7.18.78.H01.1.454.light.4.raw
tacgagtatgcacgaccggtgctcgatttagtgtgagtagtttgggtttggggcgtttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccaccctcctccatactcgta

SEQ ID NO: 536075 - DNA, 485 bp, Homo sapiens
  misc_feature: HIJSMM301ASXFN.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtgg

SEQ ID NO: 536076 - DNA, 488 bp, Homo sapiens
  misc_feature: HIJSMM301CD0DI.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttccccctcactttcggcggagggaccaaggtggaggatcaagcgaactgtggctgcaccat

SEQ ID NO: 536077 - DNA, 488 bp, Homo sapiens; identical to SEQ ID NO: 535081
  misc_feature: HIJSMM301BCTGQ.26.23.C01.1.454.light.4.raw

SEQ ID NO: 536078 - DNA, 446 bp, Homo sapiens
  misc_feature: HIJSMM301DMPZ0.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgatgtcttcggatctgggaccaaggtcaccgtcctaagtcagcccaaggccaacccctctgtcactctgttcccgccctcctccatactcgta

SEQ ID NO: 536079 - DNA, 485 bp, Homo sapiens; identical to SEQ ID NO: 536075
  misc_feature: HIJSMM301CHBN2.17.21.B10.1.454.light.4.raw

SEQ ID NO: 536080 - DNA, 496 bp, Homo sapiens
  misc_feature: HIJSMM301DWLBJ.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagataccattggagaaagagtgatgacgcagtctccagccaccctgtctgtgtctccaggggaaagcgccactctctcctgcagggacagtcagactgttagcaccaacttagcctggtatcagcagaaacctggccagtctcccaggctcctcatctatggtgcatccaccagggcccctggtgtcccagccaggttcagtggcagtgggtctgggacagagttcactctcaccatcagcggcctgcagtctgaagattttgcagtttattactgtcagcagtataattactggccgccgacgttggcccaagggaccaaggtggaaatcaaacgaactgtggctgcaccatctgtcttcta

SEQ ID NO: 536081 - DNA, 488 bp, Homo sapiens
  misc_feature: HIJSMM301CNUV7.26.23.C01.1.454.light.4.raw
  modified_base (480)..(480): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtggctgcnccatctgt

SEQ ID NO: 536082 - DNA, 454 bp, Homo sapiens; identical to SEQ ID NO: 534964
  misc_feature: HIJSMM301DGUB5.19.86.H09.1.454.light.4.raw

SEQ ID NO: 536083 - DNA, 494 bp, Homo sapiens
  misc_feature: HIJSMM301B02X0.52.33.C11.1.454.light.4.raw
cgcagtacgacacgaccggtgctcgatttagagtgagctcgttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgcccctc

SEQ ID NO: 536084 - DNA, 493 bp, Homo sapiens
  misc_feature: HIJSMM301AIRUR.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcgtcggagggacgaacgacggagatcagacgaactagtggcgtcgcaccactctgtcttcta

SEQ ID NO: 536085 - DNA, 326 bp, Homo sapiens
  misc_feature: HIJSMM301AKH3P.40.41.D08.1.454.light.4.raw
tctagcgactcacgaccggtgctcgatttagtcacgcgagaaagggaaagggcccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcggggtgttcggcggagggaccaagctgaccgtcctaggtcagcccaaggctgccccctcggtcactctgttcccaccctcctcagtcgctaga

SEQ ID NO: 536086 - DNA, 507 bp, Homo sapiens
  misc_feature: HIJSMM301BGPN8.12.73.G07.1.454.light.4.raw
atacgacgtacacgaccggtgctcgatttagctctacgctcaggggctgggcccaaggaagcagcactggtggtgcctcagccatggcctggaccgttctcctcctcggcctcctctctcactgcacagcctctgtgacctcctatgtactgattcagtcgccctcggtgtcagtggccccaggacagacggccacgattacctgtggaggagacaatattgtcaccaaaagtgttcactggtaccagcagaagccaggccaggcccctgtggtggtcgtctatgatgatagcgaccggccctcggggatccctgagcgattctctggctccaactctgggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttcccgccct

SEQ ID NO: 536087 - DNA, 492 bp, Homo sapiens
  misc_feature: HIJSMM301BG9BU.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccggggaccaagctggaaatcaagcgaactgtggctgcaccatctgtcttcatt

SEQ ID NO: 536088 - DNA, 510 bp, Homo sapiens
  misc_feature: HIJSMM301AKLDV.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtgggcgtggcatttgggtgttcggcggagggaccaaactgaccgtcctaggtcagcccaaggctgccccctcggtcactctgttcccaccctcctcgctacgtaga

SEQ ID NO: 536089 - DNA, 474 bp, Homo sapiens
  misc_feature: HIJSMM301ET8LA.48.45.E01.1.454.light.4.raw
agtatacatacacgaccggtgctcgatttagtgagtcagtaagggaaaggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcagggtccctgctcgcttctctggctccaagtctggcaacacggcctccctgaccatctctgggctccaggctgaagatgaggctgattatttctgctgctcatatgcagccaactattatgtcttcggaactgagaccaaggtcaccgtcct

SEQ ID NO: 536090 - DNA, 495 bp, Homo sapiens; identical to SEQ ID NO: 535712
  misc_feature: HIJSMM301BXD1S.27.78.H01.1.454.light.4.raw

SEQ ID NO: 536091 - DNA, 469 bp, Homo sapiens
  misc_feature: HIJSMM301A4H1S.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggagatcaaacgaa

SEQ ID NO: 536092 - DNA, 486 bp, Homo sapiens
  misc_feature: HIJSMM301DOXLI.5.39.D06.1.454.light.4.raw
atcagacacgcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccgaaggtcgaaatagagacgaactgtggctgcaccatctgtctt

SEQ ID NO: 536093 - DNA, 499 bp, Homo sapiens
  misc_feature: HIJSMM301ENM2Y.11.75.G09.1.454.light.4.raw
cgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaac

SEQ ID NO: 536094 - DNA, 497 bp, Homo sapiens
  misc_feature: HIJSMM301AHQ86.9.1.A01.1.454.light.4.raw
tgatacgtctcacgaccggtgctcgatttagacgtctcatcagggggagctgctcagttaggacccagagggaaccatggaaaccccaacgcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcactcttccccg

SEQ ID NO: 536095 - DNA, 501 bp, Homo sapiens
  misc_feature: HIJSMM301C5K0Z.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggaggaccaagctgaccgtcctgggtcagcccaaggctgccccctcggt

SEQ ID NO: 536096 - DNA, 444 bp, Homo sapiens
  misc_feature: HIJSMM301CLHFV.7.18.B07.1.454.light.4.raw
cgtgtctctacacgaccggtgctcgatttagtcgctgcgtaagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctctagagacacg

SEQ ID NO: 536097 - DNA, 484 bp, Homo sapiens; identical to SEQ ID NO: 535240
  misc_feature: HIJSMM301ESQNN.47.60.F05.1.454.light.4.raw

SEQ ID NO: 536098 - DNA, 488 bp, Homo sapiens
  misc_feature: HIJSMM301D3IZN.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccatcctcctcga

SEQ ID NO: 536099 - DNA, 493 bp, Homo sapiens; identical to SEQ ID NO: 535745
  misc_feature: HIJSMM301AUBBE.47.78.H01.1.454.light.4.raw

SEQ ID NO: 536100 - DNA, 418 bp, Homo sapiens
  misc_feature: HIJSMM301D1CWP.41.53.E09.1.454.light.4.raw
tctatactatcacgaccggtgctcgatttagagagagtgtgttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccctcggtcactctgttcccaccctcctcatagtataga

SEQ ID NO: 536101 - DNA, 444 bp, Homo sapiens; identical to SEQ ID NO: 535192
  misc_feature: HIJSMM301A7L5H.5.9.A09.1.454.light.4.raw

SEQ ID NO: 536102 - DNA, 454 bp, Homo sapiens; identical to SEQ ID NO: 534964
  misc_feature: HIJSMM301EAH3H.19.86.H09.1.454.light.4.raw

SEQ ID NO: 536103 - DNA, 490 bp, Homo sapiens
  misc_feature: HIJSMM301C3UB5.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagggggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttcccgcc

SEQ ID NO: 536104 - DNA, 500 bp, Homo sapiens
  misc_feature: HIJSMM301B0DTS.43.33.C11.1.454.light.4.raw
tgtgagtagtcacgaccggtgctcgatttagagtgagctcgttgggtttggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagattttctctcgtcatcactggtctacagtctgacgacggcgcaatgtacttctgtcaacactatgcctctccccctactaattacgttcgaggacggaactagtacaactcaactacgtactagtggcgtcgcaccaactcttcg

SEQ ID NO: 536105 - DNA, 507 bp, Homo sapiens; identical to SEQ ID NO: 535316
  misc_feature: HIJSMM301A8PE2.18.37.D04.1.454.light.4.raw

SEQ ID NO: 536106 - DNA, 446 bp, Homo sapiens
  misc_feature: HIJSMM301C0GYT.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccgccctcctccatactcgta

SEQ ID NO: 536107 - DNA, 504 bp, Homo sapiens
  misc_feature: HIJSMM301CO9UK.41.33.C11.1.454.light.4.raw
tctatactatcacgaccggtgctcgatttagagtgagctcgttgggtttggggctgggcctcaggaagcagcatcggaggtgcctcagccatggcgtggatccctctcttcctcggcgtccttgcttcctgcacagtttccgtggcctcctcggaattgactcaggcaccctcagtgtccgtgtctccaggacagacagccagaatcacctgctctggagacacgttgggggagacatttgcttcctggtatcaacagaggccaggccagtcccctatcctggtcatctttcaggatgacaaacggccctctggcatccctgaacgcttctctggttccaggtcaggaaacagagccactctaaccatcaccgagacccaggctgtcgatgaggctgactattactgtcaggcctgggacagaaacactggcatattcggcggagggaccaagctgaccgtcctacgtcagcccaaggctgccccctcggtcactctgttcccg

SEQ ID NO: 536108 - DNA, 516 bp, Homo sapiens
  misc_feature: HIJSMM301CHCB8.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccacctcctcacg

SEQ ID NO: 536109 - DNA, 447 bp, Homo sapiens; identical to SEQ ID NO: 535201
  misc_feature: HIJSMM301C80WW.18.9.A09.1.454.light.4.raw

SEQ ID NO: 536110 - DNA, 461 bp, Homo sapiens
  misc_feature: HIJSMM301CHUL7.4.39.D06.1.454.light.4.raw
agcactgtagcacgaccggtgctcgatttagtgacatctcgcagttctttggggcttctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggagggtcccaccaacattcagcggcagtggatctgggacagagttcactctaaccatcagcagcctgcagcctgatgatcttggaacttatttctgccagcaatataatagttattggacgttcggccaggggaccaaggtcgaaatgagacgaactgtggctgcaccatctgtcttcatcttcccgccatctgactacagtgct

SEQ ID NO: 536111 - DNA, 508 bp, Homo sapiens
  misc_feature: HIJSMM301BJLUR.43.67.G01.1.454.light.4.raw
tgtgagtagtcacgaccggtgctcgatttagagtatacatattgggtttggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaaatacaaacgaactgtggctgcaccatctgtctt

SEQ ID NO: 536112 - DNA, 393 bp, Homo sapiens
  misc_feature: HIJSMM301AQOKZ.52.4.A04.1.454.light.4.raw
cgcagtacgacacgaccggtgctcgatttagagtagtgatcagggagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacagaagcactctggtgttcggcggagggaccaggctgaccgtcctaggtcagcccaaggctgccccctggtcactctgttcccgccctcctctatacgatcg

SEQ ID NO: 536113 - DNA, 415 bp, Homo sapiens
  misc_feature: HIJSMM301DW6YS.18.78.H01.1.454.light.4.raw
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgccctcctccatactcgta

SEQ ID NO: 536114 - DNA, 487 bp, Homo sapiens
  misc_feature: HIJSMM301EERBH.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggaggatcaaacgaaactgtggctgcaccatctgtcttcta

SEQ ID NO: 536115 - DNA, 446 bp, Homo sapiens
  misc_feature: HIJSMM301AESBY.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttccgccctcctccatactcgta

SEQ ID NO: 536116 - DNA, 487 bp, Homo sapiens
  misc_feature: HIJSMM301AU70L.4.72.G06.1.454.light.4.raw
agcactgtagcacgaccggtgctcgatttagctacgactgcaagggaaaggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcggccaggaccgaaggtggaaatacaaacgaactagtggcgtgcaccat

SEQ ID NO: 536117 - DNA, 505 bp, Homo sapiens
  misc_feature: HIJSMM301A0GOD.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccat

SEQ ID NO: 536118 - DNA, 415 bp, Homo sapiens
  misc_feature: HIJSMM301A9NC0.18.78.H01.1.454.light.4.raw
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccaccctcctccatactcgta

SEQ ID NO: 536119 - DNA, 486 bp, Homo sapiens
  misc_feature: HIJSMM301BLIJB.14.55.E11.1.454.light.4.raw
  modified_base (425)..(425): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccncctctacgttcggcggacggacgaggcggagatacagacgaacgtggtcggctcgccaact

SEQ ID NO: 536120 - DNA, 495 bp, Homo sapiens
  misc_feature: HIJSMM301CYR7F.22.20.B09.1.454.light.4.raw
acatacgcgtcacgaccggtgctcgatttagtgtagtgtgaaggggagagctgctcagttaggacccagatggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccgggtcagactatctgctcaccatcggcggtctggaacctgaagattctgcactatattactgtcagctttatgttaattcacctccgtcgtacatctttggccaggggaccaagctggagatcaaacgaactgtggctgcaccatctgtcttca

SEQ ID NO: 536121 - DNA, 447 bp, Homo sapiens; identical to SEQ ID NO: 535020
  misc_feature: HIJSMM301CQYUI.18.9.A09.1.454.light.4.raw

SEQ ID NO: 536122 - DNA, 463 bp, Homo sapiens; identical to SEQ ID NO: 535062
  misc_feature: HIJSMM301CU9VB.11.73.G07.1.454.light.4.raw

SEQ ID NO: 536123 - DNA, 473 bp, Homo sapiens; identical to SEQ ID NO: 535262
  misc_feature: HIJSMM301CR8A7.8.67.G01.1.454.light.4.raw

SEQ ID NO: 536124 - DNA, 494 bp, Homo sapiens; identical to SEQ ID NO: 535478
  misc_feature: HIJSMM301D1SXS.10.79.H02.1.454.light.4.raw

SEQ ID NO: 536125 - DNA, 489 bp, Homo sapiens
  misc_feature: HIJSMM301AISY0.4.33.C11.1.454.light.4.raw
agcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaacggtaggagatacaaacgaa

SEQ ID NO: 536126 - DNA, 486 bp, Homo sapiens
  misc_feature: HIJSMM301A7JVO.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaaggaccgaaggtaggaaatacaaacgaaactgtggctgcaccatctgtcttcta

SEQ ID NO: 536127 - DNA, 443 bp, Homo sapiens
  misc_feature: HIJSMM301EXKM6.4.39.D06.1.454.light.4.raw
agcactgtagcacgaccggtgctcgatttagtgacatctcgcagttctttggggcttctcctggtctctggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggagggtcccaccaacattcagcggcagtggatctgggacagagttcactctaaccatcagcagcctgcagcctgatgatcttggaacttatttctgccagcaatataatagttattggacgttcggccaggggaccaaggtcgaaatgagacgaactgtggctgcaccatctgtcttcatcttcccgccatctgactacagtgct

SEQ ID NO: 536128 - DNA, 496 bp, Homo sapiens
  misc_feature: HIJSMM301A96NX.41.23.C01.1.454.light.4.raw
tctatactatcacgaccggtgctcgatttagtacacgtgattagggattgggggtgggtccaggaggcagaactctgggtgtctcaccatggcctggatccctctacttctccccctcctcactctctgcacaggctctgtgacctcctatgagctgacacagccaccctccggtgtcagtgtccccaggacagacggccaggatcgactgctctggagaagcattggcaacggaatatgcttattggtaccagcagaagccaggtcaggcccccactgttaataatatatagagacagtgagaggccctccagggatacctgagcgtatgtctggctccagctcagggacaacagtcacgttgaccatcactggagtccaggcagaagacgaggctgactatcactgtcaatcagcagacagtagtggttcttattgggtgttcggcggagggaccaagctgaccgtccttggtcagcccaaggctgccccctcc

SEQ ID NO: 536129 - DNA, 447 bp, Homo sapiens; identical to SEQ ID NO: 535020
  misc_feature: HIJSMM301BDC95.18.9.A09.1.454.light.4.raw

SEQ ID NO: 536130 - DNA, 470 bp, Homo sapiens
  misc_feature: HIJSMM301DFZK3.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctggactgaagtgcatatgaagagaactgtgg

SEQ ID NO: 536131 - DNA, 326 bp, Homo sapiens
  misc_feature: HIJSMM301CQMPH.49.14.B03.1.454.light.4.raw
agtcgagagacacgaccggtgctcgatttagtgtgagtagttccgcgggcacgaccggtgctcgatttagtagcatactgttgggtttggggatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 536132 - DNA, 492 bp, Homo sapiens
  misc_feature: HIJSMM301BMHL1.5.57.F02.1.454.light.4.raw
atcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcgcccagggaccgacagtggatatcaggcgaactgtggctgcaccatctgtctt

SEQ ID NO: 536133 - DNA, 487 bp, Homo sapiens
  misc_feature: HIJSMM301A7H6L.51.78.H01.1.454.light.4.raw
cgatcgtatacacgaccggtgctcgatttagtgtgagtagtttgggtttggggatgggggcacttctccctctaacactctcccctgttgaagctctttgtgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtacccctcagctcactttcggcggagggaccaaggtggagatcaaacgaa

SEQ ID NO: 536134 - DNA, 520 bp, Homo sapiens
  misc_feature: HIJSMM301DY7I6.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctgataccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaacgggaccgaacggtaggaaggtacaaacgaaacctagtggcgtgcgaccactctgtcttcatcttcccgtccact

SEQ ID NO: 536135 - DNA, 468 bp, Homo sapiens; identical to SEQ ID NO: 535969
  misc_feature: HIJSMM301A9S45.3.82.H05.1.454.light.4.raw

SEQ ID NO: 536136 - DNA, 512 bp, Homo sapiens
  misc_feature: HIJSMM301CV88G.49.23.C01.1.454.light.4.raw
agtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttcccaccct

SEQ ID NO: 536137 - DNA, 488 bp, Homo sapiens; identical to SEQ ID NO: 535568
  misc_feature: HIJSMM301AKH3T.21.4.A04.1.454.light.4.raw

SEQ ID NO: 536138 - DNA, 442 bp, Homo sapiens
  misc_feature: HIJSMM301AL2EM.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctccggtcactctgttcccaccctcctcgtatctctcg

SEQ ID NO: 536139 - DNA, 472 bp, Homo sapiens; identical to SEQ ID NO: 535992
  misc_feature: HIJSMM301DQPNL.11.76.G10.1.454.light.4.raw

SEQ ID NO: 536140 - DNA, 504 bp, Homo sapiens; identical to SEQ ID NO: 535128
  misc_feature: HIJSMM301BPSID.19.85.H08.1.454.light.4.raw

SEQ ID NO: 536141 - DNA, 447 bp, Homo sapiens; identical to SEQ ID NO: 535201
  misc_feature: HIJSMM301BPNAI.18.9.A09.1.454.light.4.raw

SEQ ID NO: 536142 - DNA, 501 bp, Homo sapiens
  misc_feature: HIJSMM301ALMCF.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcact

SEQ ID NO: 536143 - DNA, 378 bp, Homo sapiens
  misc_feature: HIJSMM301BG8SY.12.66.F11.1.454.light.4.raw
atacgacgtacacgaccggtgctcgatttagtcacgcgagaaagggaaagagccaccctctcctgcagggccagtcagagtattagcaccaacctagcctagtatcaggagaaacctggccagactcccagacttctcatctatgctgcatcctccaggtccactgacatcccagacagggttcagtggcagtgggtctgggacagacttcactctcaccatcaccagactgcagtctgatgattttgcactttattactgtcagcactataataattggcctccggagtacacctttggccaggggaccaagctggagatcaaacgactgtggctgcaccatctgtcttcatcttcccgccatctgatacgtcgtat

SEQ ID NO: 536144 - DNA, 512 bp, Homo sapiens
  misc_feature: HIJSMM301C9JRV.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctacttcgttcggacggacggaacgaggacgagactacgacgaaccgtagtggtcggtctcgaccaactacttcgttcgttcctta

SEQ ID NO: 536145 - DNA, 493 bp, Homo sapiens
  misc_feature: HIJSMM301CNETP.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcgtcggaggacgaacgaggacgatcagacgaactagtggcgtcgcgaccactctcgtcttcta

SEQ ID NO: 536146 - DNA, 489 bp, Homo sapiens
  misc_feature: HIJSMM301CALD6.19.57.F02.1.454.light.4.raw
  modified_base (456)..(456): a, c, t, g, unknown or other
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttccccctcactttcggcggaggaccaaggtggngatcaagcgaactgtggctgcaccatctgtctt

SEQ ID NO: 536147 - DNA, 485 bp, Homo sapiens; identical to SEQ ID NO: 535985
  misc_feature: HIJSMM301B5JQ3.15.1.A01.1.454.light.4.raw

SEQ ID NO: 536148 - DNA, 516 bp, Homo sapiens
  misc_feature: HIJSMM301CXTHO.51.27.C05.1.454.light.4.raw
cgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctcggtcactctgttccccg

SEQ ID NO: 536149 - DNA, 460 bp, Homo sapiens
  misc_feature: HIJSMM301CK62L.53.70.G04.1.454.light.4.raw
cgcgtatacacacgaccggtgctcgatttagtgtagtgtgaagggaaaggggctgggcctcaggaagcagcatcggaggtgcctcagccatggcatggatccctctcttcctcggcgtccttgcttactgcacaggatgcgtggcctcctatgagctgactcagccaccctcagtgtccgtgtccccaggacagacagccagcatcacctgctctggagacaagttgggggataaatatgctggctggtatcagcagaagccaggccagtcccctgtgttagtcatctatcaagatacaaagcggccctcagggatccctgagcgattctctggctccaactctgggaacacagccactctgaccatcagcgggactcaggctatcgatgaggctgactattactgtcaggcgtgggacagccgcactggggtgttcggcggagggaccaagctgaccgt

SEQ ID NO: 536150 - DNA, 514 bp, Homo sapiens
  misc_feature: HIJSMM301CWW6L.52.55.E11.1.454.light.4.raw
cgcagtacgacacgaccggtgctcgatttagcactcgcacgttgggtttggggcctgggcctcaggaagcagcatcgggggtggccgcagccatggcctggaccgctctccttctgagcctccttgctcactttacagggtctgcggcctcccatgacctgactcagtcactctcagtgtcggtggccctgggacagacggccactattacctgtgggggatacaacattggaactaaaaatgtgcagtggtaccagcagaagccaggccaggcccctgtgttggtcatctatagggatcgaagacgggcctctgggattcctgagcgattctctggctccaactcggagaacacggccaccctgaccatcagaagtgcccaagtcggtgatgaggcagactattactgccaggtgtgggacgagtggtgttgtgatattcggcggagggaccaagctgaccgtcctaagtcagcccaaggctgccccctcggtcactctgttcccgccctcct

SEQ ID NO: 536151 - DNA, 471 bp, Homo sapiens
  misc_feature: HIJSMM301BLXL6.49.9.A09.1.454.light.4.raw
agtcgagagacacgaccggtgctcgatttagcgagacgcgcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccaaggtggagatcaaacgaactgtggctgcacca

SEQ ID NO: 536152 - DNA, 483 bp, Homo sapiens; identical to SEQ ID NO: 535013
  misc_feature: HIJSMM301BHVCM.11.76.G10.1.454.light.4.raw

SEQ ID NO: 536153 - DNA, 488 bp, Homo sapiens; identical to SEQ ID NO: 535169
  misc_feature: HIJSMM301DKO08.16.72.G06.1.454.light.4.raw

SEQ ID NO: 536154 - DNA, 468 bp, Homo sapiens
  misc_feature: HIJSMM301DP89K.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagatttaatttcaccatcagcagcctccaacgtgatgatgttgcaacatactattgtcagcaatatgattttgctcctccgagtgccacttttgcgggggaccaggtggacatcaaacgaa

SEQ ID NO: 536155 - DNA, 515 bp, Homo sapiens
  misc_feature: HIJSMM301DSWK9.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctacttacgttcggacgggacggaacgacggacgagtactacgacgaaccgtaagttggcgtcgcgaccaactacttcgtcgttcctta

SEQ ID NO: 536156 - DNA, 495 bp, Homo sapiens
  misc_feature: HIJSMM301BNHTZ.51.55.E11.1.454.light.4.raw
cgatcgtatacacgaccggtgctcgatttagcactcgcacgttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgt

SEQ ID NO: 536157 - DNA, 445 bp, Homo sapiens
  misc_feature: HIJSMM301A50Z9.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgacacgcggag

SEQ ID NO: 536158 - DNA, 503 bp, Homo sapiens; identical to SEQ ID NO: 535044
  misc_feature: HIJSMM301DM3C9.19.78.H01.1.454.light.4.raw

SEQ ID NO: 536159 - DNA, 490 bp, Homo sapiens
  misc_feature: HIJSMM301CTIG5.7.59.F04.1.454.light.4.raw
cgtgtctctacacgaccggtgctcgatttagtacacacacttagggattggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccaggtggaaatcaaacgaactgtggctgcaccatctgtcttc

SEQ ID NO: 536160 - DNA, 508 bp, Homo sapiens
  misc_feature: HIJSMM301BA0FC.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctagtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgcc

SEQ ID NO: 536161 - DNA, 518 bp, Homo sapiens
  misc_feature: HIJSMM301COMMB.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctcgttcccgccctcctcacg

SEQ ID NO: 536162 - DNA, 484 bp, Homo sapiens
  misc_feature: HIJSMM301CIC5E.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtggctgca

SEQ ID NO: 536163 - DNA, 487 bp, Homo sapiens
  misc_feature: HIJSMM301CNLDW.5.48.E04.1.454.light.4.raw
atcagacacgcacgaccggtgctcgatttagagagcgtcacagagagaaggggagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagactttgcgctgtatttctgtcagcagtatgttttcgcacctttcactttcggcggagggaccaaggtggagagcagacgaactgtggctgcaccatctgtcttcatcttcccgccat

SEQ ID NO: 536164 - DNA, 447 bp, Homo sapiens; identical to SEQ ID NO: 535201
  misc_feature: HIJSMM301DL40Y.18.9.A09.1.454.light.4.raw

SEQ ID NO: 536165 - DNA, 486 bp, Homo sapiens
  misc_feature: HIJSMM301DCKVI.5.71.G05.1.454.light.4.raw
atcagacacgcacgaccggtgctcgatttagtgtcgtcgcaagagagaggggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtgtcttacacagctccagcaataagaaccacttagcttggtaccagcagaaaccaggacagcctcctaaggtactcatttactgggcatctacccggggatccggggtccctgaccgattcagtggcagcgggtctgggacagatttcactctcaccatcagcagtctgcaggctgaagatgtggcagtttattactgtcagcaatattataccactccgtgcagttttggcctggggaccaagctggagatcaaacgaa

SEQ ID NO: 536166 - DNA, 471 bp, Homo sapiens
  misc_feature: HIJSMM301D1U04.2.82.H05.1.454.light.4.raw
  modified_base (469)..(469): a, c, t, g, unknown or other
acgctcgacacacgaccggtgctcgatttagtcgagctctctcgcgggggtgggtccaggaggcagaactctgggtgtctcaccatggcctggatccctctacttctcccctcttctactctctgcacaggctctgaggcctcctatgagctgacacagccaccgtcggtgtcagtgtccccacggacagacggccaggatcacctgctctggagatgcattgccagatcaatatgctaattggtaccagcagaagccaggccaggcccctgtgctggtgatatataaagacagtgagaggccctcagggatccctgagcgattctctggctccagctcagggacaacagtcacgttgaccatcagtggagtccaggcagaggatgaggctgactattactgtcaatcagcagacaccagtggtaatgattatgtcttcggaactgggaccaagtcaccgtcctaggtnag

SEQ ID NO: 536167 - DNA, 509 bp, Homo sapiens
  misc_feature: HIJSMM301EVF6P.3.70.G04.1.454.light.4.raw
agacgcactccacgaccggtgctcgatttagtgtagtgtgaagggaaaggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccacttagcctggtaccagcagaaacctggccagcctcccagtctcctcatctatggagcacacaacagggccactggcatcccagccaggttcagtggcagtgggtctgggacagacttcaccctcatcatcagccgcctagagcctgaagattttgcagtttattactgtcagcagggttacttctggcccaactttcggccctgggaccaaatggatatcaaacgaaactgtggctgcacccaatcttgtctttccatcttcccgcccat

SEQ ID NO: 536168 - DNA, 445 bp, Homo sapiens
  misc_feature: HIJSMM301EK8VU.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatacggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccgccctcctcagacgtatca

SEQ ID NO: 536169 - DNA, 487 bp, Homo sapiens
  misc_feature: HIJSMM301C88HI.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccgaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttatactgtcagcagtataatgactggcctccgacgttcggccaagggaccaaggtggaaatcaacgaactgtggctgcaccat

SEQ ID NO: 536170 - DNA, 498 bp, Homo sapiens
  misc_feature: HIJSMM301C588U.41.82.H05.1.454.light.4.raw
tctatactatcacgaccggtgctcgatttagtcgagctctctcgcgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatatataaggcgtctagtttagaaagtggggtcccatcaaggatcagcggcagtggatctgggacagaattcactctcaccattagtagcctgcagcctgatgattttgcaacttattactgccaacaatataatgattttccgtggacgttcggccaagggaccaaggtagaaatcaaacgaactgtggctgcaccatctgtcttcatcttccccg

SEQ ID NO: 536171 - DNA, 494 bp, Homo sapiens; identical to SEQ ID NO: 534992
  misc_feature: HIJSMM301AYYGJ.9.1.A01.1.454.light.4.raw

SEQ ID NO: 536172 - DNA, 496 bp, Homo sapiens
  misc_feature: HIJSMM301CYIL8.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctcagacgttcggccagggaccaaggtggaaatcaaacgaactgtggctgcacca

SEQ ID NO: 536173 - DNA, 498 bp, Homo sapiens
  misc_feature: HIJSMM301DJL5I.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcat

SEQ ID NO: 536174 - DNA, 510 bp, Homo sapiens
  misc_feature: HIJSMM301DMUSU.14.7.A07.1.454.light.4.raw
cgtctagtaccacgaccggtgctcgatttagcacgtgtcgcagggggccctgaggaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccgtcctacgtcagcccaagg

SEQ ID NO: 536175 - DNA, 492 bp, Homo sapiens
  misc_feature: HIJSMM301ECCE1.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaaactccctcaacgttcggcggagggaccaaggtggagatcaaacgaactgtggctgcaccatctgtcttca

SEQ ID NO: 536176 - DNA, 482 bp, Homo sapiens
  misc_feature: HIJSMM301DBSF1.5.70.G04.1.454.light.4.raw
atcagacacgcacgaccggtgctcgatttagtgtagtgtgaagggaaagggggaggtcagacccacgtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcacttttcggcggagggaccaaggtggagatcaaacgaactgtggctgca

SEQ ID NO: 536177 - DNA, 488 bp, Homo sapiens
  misc_feature: HIJSMM301C9A21.41.33.C11.1.454.light.4.raw
tctatactatcacgaccggtgctcgatttagagtgagctcgttgggtttgggggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggattatgcagtttactactgtctgcagtataaagactggcctagggtcactttcggccctgggaccaaagtaggattctaaacgaaactgtggctgcaccat

SEQ ID NO: 536178 - DNA, 511 bp, Homo sapiens
  misc_feature: HIJSMM301C7ITY.43.23.C01.1.454.light.4.raw
tgtgagtagtcacgaccggtgctcgatttagtacacgtgattagggattgggggcgccagggtcccttccaatatcagcaccatggcctggactcctctctttctttgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctaagtcagcccaaggctgccccctggtcactctgtctcgccctct

SEQ ID NO: 536179 - DNA, 487 bp, Homo sapiens
  misc_feature: HIJSMM301C1UXT.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttccccctcactttcggcggagggaccaaggtggagatcaagcgaactgtggctgcaccat

SEQ ID NO: 536180 - DNA, 487 bp, Homo sapiens; identical to SEQ ID NO: 535358
  misc_feature: HIJSMM301EYV0O.47.70.G04.1.454.light.4.raw

SEQ ID NO: 536181 - DNA, 444 bp, Homo sapiens; identical to SEQ ID NO: 534993
  misc_feature: HIJSMM301CFTM0.5.9.A09.1.454.light.4.raw

SEQ ID NO: 536182 - DNA, 493 bp, Homo sapiens; identical to SEQ ID NO: 535657
  misc_feature: HIJSMM301A7IC8.27.78.H01.1.454.light.4.raw

SEQ ID NO: 536183 - DNA, 500 bp, Homo sapiens
  misc_feature: HIJSMM301D6WH6.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgtagtctgaagattttgcagtttattactgtcagcagtatgatacctggcctccgtacacttttggccgggggaccaagctggaaatcaagcgaactgtggctgcaccatctgtcttcatcttccccg

SEQ ID NO: 536184 - DNA, 494 bp, Homo sapiens; identical to SEQ ID NO: 534992
  misc_feature: HIJSMM301CKT2C.9.1.A01.1.454.light.4.raw

SEQ ID NO: 536185 - DNA, 493 bp, Homo sapiens
  misc_feature: HIJSMM301BXVGY.9.19.B08.1.454.light.4.raw
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccagggtcctcatctttggttacagtaatcggccctcaggggtccctgaccgattctctggctccaagtctgacacctcagcctccctggccatcactgggctccagactgaggatgaggctcattattactgccagtcttatgacaaacgtcagaacatttgggtgttcggcggagggaccaagctgaccgtcctcagtcagccccg

SEQ ID NO: 536186 - DNA, 463 bp, Homo sapiens
  misc_feature: HIJSMM301BBOOL.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaactgtggctgcaccatctgtcttcatcttcccgccatctgatcgtagcact

SEQ ID NO: 536187 - DNA, 499 bp, Homo sapiens
  misc_feature: HIJSMM301CI32L.11.67.G01.1.454.light.4.raw
cgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaa

SEQ ID NO: 536188 - DNA, 485 bp, Homo sapiens; identical to SEQ ID NO: 535880
  misc_feature: HIJSMM301B2BPN.7.75.G09.1.454.light.4.raw

SEQ ID NO: 536189 - DNA, 496 bp, Homo sapiens; identical to SEQ ID NO: 535109
  misc_feature: HIJSMM301B2FKX.16.78.H01.1.454.light.4.raw

SEQ ID NO: 536190 - DNA, 501 bp, Homo sapiens
  misc_feature: HIJSMM301CYLWL.48.87.H10.1.454.light.4.raw
agtatacatacacgaccggtgctcgatttagcagtactgcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtcactttcggccctgggaccaaataaatgtcaatcgaactgtggctgcaccatctgtcttcatt

SEQ ID NO: 536191 - DNA, 484 bp, Homo sapiens
  misc_feature: HIJSMM301CAEOX.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcaatccagtttgcaaaagtggggtcccttcaaggttcagtggcagtggatctgggacagatttcactctcaccatcagcagtctgcaacctgaagattttgcaacttactactgtcaacagagttacaatacccctcggctcacttcgcggaggaccgaaggtggagatcaaacgaactgtgctgcacca

SEQ ID NO: 536192 - DNA, 453 bp, Homo sapiens
  misc_feature: HIJSMM301DE5IF.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgtcccaccctcctccacgagagta

SEQ ID NO: 536193 - DNA, 498 bp, Homo sapiens
  misc_feature: HIJSMM301C7NFG.51.83.H06.1.454.light.4.raw
cgatcgtatacacgaccggtgctcgatttagatcacgtgcgtcgcgggggaactgctcagttaggacccagagggaaccatggaagccccagctcagcttctcttcctcctgctactctgcctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttatattgtcagcagcgaaacaactggcctccttggacgttcggccaagggaccaaggtggaatacaacgaactgtggctgcaccatctgtcttcatcttccccg

SEQ ID NO: 536194 - DNA, 444 bp, Homo sapiens; identical to SEQ ID NO: 535856
  misc_feature: HIJSMM301A97TD.9.9.A09.1.454.light.4.raw

SEQ ID NO: 536195 - DNA, 477 bp, Homo sapiens
  misc_feature: HIJSMM301AJX3Z.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtggacatcagcagtgaggtggttttcggcggagggaccaagctgaccgtcctaagtcagcccaa

SEQ ID NO: 536196 - DNA, 487 bp, Homo sapiens
  misc_feature: HIJSMM301CGRMM.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccaaggtggagatcaacgaa

SEQ ID NO: 536197 - DNA, 501 bp, Homo sapiens
  misc_feature: HIJSMM301A3FNG.9.71.G05.1.454.light.4.raw
tgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtctgagtcagcccaaggctgccccctccggtcactctgttcccaccctcctcagacgtatca

SEQ ID NO: 536198 - DNA, 383 bp, Homo sapiens
  misc_feature: HIJSMM301A8WE8.41.86.H09.1.454.light.4.raw
tctatactatcacgaccggtgctcgatttagtgctatagacttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 536199 - DNA, 489 bp, Homo sapiens
  misc_feature: HIJSMM301A0PSI.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatacttggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccgaagggaccgaaggtggaactacaaacgaactgtggcgtgcaccatctgtcttcatcttcccgccatctgactagtctacg

SEQ ID NO: 536200 - DNA, 498 bp, Homo sapiens
  misc_feature: HIJSMM301CROMD.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcatcttcccgcc

SEQ ID NO: 536201 - DNA, 494 bp, Homo sapiens; identical to SEQ ID NO: 534992
  misc_feature: HIJSMM301B0GD6.9.1.A01.1.454.light.4.raw

SEQ ID NO: 536202 - DNA, 483 bp, Homo sapiens
  misc_feature: HIJSMM301AQAPN.43.24.C02.1.454.light.4.raw
tgtgagtagtcacgaccggtgctcgatttagtacagatcgttagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatagaaacaactatttggattggtatctgcagaagccagggcagcctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgctcactttcggcggagggaccaaggtggagatcaaacgaa

SEQ ID NO: 536203 - DNA, 454 bp, Homo sapiens; identical to SEQ ID NO: 534964
  misc_feature: HIJSMM301CRG41.19.86.H09.1.454.light.4.raw

SEQ ID NO: 536204 - DNA, 444 bp, Homo sapiens; identical to SEQ ID NO: 535856
  misc_feature: HIJSMM301ADRVW.9.9.A09.1.454.light.4.raw

SEQ ID NO: 536205 - DNA, 475 bp, Homo sapiens
  misc_feature: HIJSMM301EN588.48.49.E05.1.454.light.4.raw
agtatacatacacgaccggtgctcgatttagagcgactagcaacacacaaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcgtacgttcggccaagggaccaaggtggaaatcaaacgaa

SEQ ID NO: 536206 - DNA, 487 bp, Homo sapiens
  misc_feature: HIJSMM301BV4BA.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaa

SEQ ID NO: 536207 - DNA, 448 bp, Homo sapiens
  misc_feature: HIJSMM301A0CIN.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccacccctcctccatactcta

SEQ ID NO: 536208 - DNA, 498 bp, Homo sapiens
  misc_feature: HIJSMM301EHWWC.11.75.G09.1.454.light.4.raw
cgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcagggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaac

SEQ ID NO: 536209 - DNA, 499 bp, Homo sapiens
  misc_feature: HIJSMM301AYPMO.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccgaaggtggaaatcaaacgaactgtggctgcacc

SEQ ID NO: 536210 - DNA, 485 bp, Homo sapiens
  misc_feature: HIJSMM301AK0I3.43.54.E10.1.454.light.4.raw
tgtgagtagtcacgaccggtgctcgatttagatcgtagcagaacacacaaagggggatcaggactcctcagttcaccttctcacaatgaggctccctgctcagctcctggggctgctaatgctctgggtcccaggatccattggggatattgtgctgactcagtctccactctccctctccgtcacccttggacagtcggtgtccatctcctgcaggtctagtcacagcgtcctacacagtgatggaagaacctacttggattggtttcagcagaggccaggccaatctccaaggctcctaatttataaggtttctagtcgggactctggggtcccagacagattcagcggcagtgggtcaggcactgacttcacactgaaaatcagtagtgtggaggctgaggatgttgccatttattactgcatgcaagggacacactggccgtacacttttggccaggggaccaagctggagatcaaacgaa

SEQ ID NO: 536211 - DNA, 491 bp, Homo sapiens
  misc_feature: HIJSMM301CVA3F.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactgt

SEQ ID NO: 536212 - DNA, 497 bp, Homo sapiens; identical to SEQ ID NO: 535740
  misc_feature: HIJSMM301AM08Z.3.71.G05.1.454.light.4.raw

SEQ ID NO: 536213 - DNA, 488 bp, Homo sapiens
  misc_feature: HIJSMM301DEI56.16.72.G06.1.454.light.4.raw
tgtactactccacgaccggtgctcgatttagctacgactgcaagggaaaggggaggaactgctcagttaggacccagacggaaccatggaagccccacgcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcatttcggcggagggaccaaggtggagatcaaacgaactgtggctgcaccat

SEQ ID NO: 536214 - DNA, 485 bp, Homo sapiens; identical to SEQ ID NO: 535880
  misc_feature: HIJSMM301DPTR6.7.75.G09.1.454.light.4.raw

SEQ ID NO: 536215 - DNA, 502 bp, Homo sapiens
  misc_feature: HIJSMM301APODW.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggtcggagggaccgaaggtggagatacaaacgaactgtggctgcaccatctgtcttcatcttccccg

SEQ ID NO: 536216 - DNA, 498 bp, Homo sapiens
  misc_feature: HIJSMM301CX26T.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggtacttttggccgaggggaccaagctggagatacaaacgaactgtggctgcacatctgtctt

SEQ ID NO: 536217 - DNA, 503 bp, Homo sapiens
  misc_feature: HIJSMM301B5PKM.15.59.F04.1.454.light.4.raw
tctacgtagccacgaccggtgctcgatttagtacacacacttagggattggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtccctaggttcagcccaacggctgccccctccggtcgactctgttccgtcccctcctccgtctaccgttaga

SEQ ID NO: 536218 - DNA, 511 bp, Homo sapiens
  misc_feature: HIJSMM301BDKN1.16.1.A01.1.454.light.4.raw
tgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgacgtctctggcctccagactgaggacgaggctgattattactgccactcatatagaagtagtactactcctgtggttttcggtcggagggacaagctgacgtccctaggtcagcccaaggctgccccctccggtcactctgttccccg

SEQ ID NO: 536219 - DNA, 447 bp, Homo sapiens; identical to SEQ ID NO: 535020
  misc_feature: HIJSMM301BT6AC.18.9.A09.1.454.light.4.raw

SEQ ID NO: 536220 - DNA, 485 bp, Homo sapiens; identical to SEQ ID NO: 535018
  misc_feature: HIJSMM301AI6J5.46.35.D02.1.454.light.4.raw

SEQ ID NO: 536221 - DNA, 494 bp, Homo sapiens
  misc_feature: HIJSMM301D4PTM.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcactctgttcccaccctcctcgctacgtaga

SEQ ID NO: 536222 - DNA, 517 bp, Homo sapiens
  misc_feature: HIJSMM301EFW68.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaacggaccgaacggtaggaaggtacgaaacgaactagtggcgtgcaccactctgtcttctatcttcccgtccact

SEQ ID NO: 536223 - DNA, 488 bp, Homo sapiens; identical to SEQ ID NO: 535081
  misc_feature: HIJSMM301CFQUW.26.23.C01.1.454.light.4.raw

SEQ ID NO: 536224 - DNA, 490 bp, Homo sapiens
  misc_feature: HIJSMM301AWY2O.43.60.F05.1.454.light.4.raw
tgtgagtagtcacgaccggtgctcgatttagtacgtcatcagggaaaggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttacccctcggacgttcggtccacggggaccgacggtcggagtgtcaagacgaactagtggctgcaccact

SEQ ID NO: 536225 - DNA, 448 bp, Homo sapiens
  misc_feature: HIJSMM301B07TJ.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactacctcatctttggtagcaacaatcggccctcagggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 536226 - DNA, 507 bp, Homo sapiens
  misc_feature: HIJSMM301BZUKY.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggaggatcaaacgaactgtggctgcaccatctgtt

SEQ ID NO: 536227 - DNA, 444 bp, Homo sapiens; identical to SEQ ID NO: 535594
  misc_feature: HIJSMM301DDNDU.9.9.A09.1.454.light.4.raw

SEQ ID NO: 536228 - DNA, 447 bp, Homo sapiens; identical to SEQ ID NO: 535020
  misc_feature: HIJSMM301D30MK.18.9.A09.1.454.light.4.raw

SEQ ID NO: 536229 - DNA, 496 bp, Homo sapiens
  misc_feature: HIJSMM301AWXC3.16.78.H01.1.454.light.4.raw
tgtactactccacgaccggtgctcgatttagtgtgagtagtttgggtttggggaggaactgctcagttaggacccagacggaaccatggaagccccacgcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgt

SEQ ID NO: 536230 - DNA, 475 bp, Homo sapiens
  misc_feature: HIJSMM301BKEGG.52.2.A02.1.454.light.4.raw
cgcagtacgacacgaccggtgctcgatttagactcatctacaggggcgaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacaggggtcccatcaaggttcagtggaagtggctctgggacagattttactttcaccatcgccagactgcagcctgaagatattgcaacatattactgtcaacagtatgataatctcccgctcactttcggtcggagggaccaaggtaggagatcagacgaacctgtgg

SEQ ID NO: 536231 - DNA, 518 bp, Homo sapiens
  misc_feature: HIJSMM301BFQD2.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccgccctcctcacg

SEQ ID NO: 536232 - DNA, 505 bp, Homo sapiens
  misc_feature: HIJSMM301BKHM2.47.65.F10.1.454.light.4.raw
agctcacgtacacgaccggtgctcgatttagctacgctctaaggggagctgtgggtagagaagacaggactcaggacaatctccagcatggccagcttccctctcctcctcaccctcctcactcactgtgcagggtcctgggcccagtctgcgttgactcagccaccctcagtgtctgggacccccgggcagacggtcgccgtctcttgttctggaagcggctccaacatcggccgtaattctgtaaactggtaccagcagctcccaggaatggcccccacactcctcatctatagggatgatcagtggccctcaggggtccctgaccgattctctggctccaagtctggcacttcagcctccctggccatcagtgggctccagtctggggatgaggctgattattactgtgcaacatgggatgacagtctgaacgcaatggtgttcggcggagggaccaaggtggccgtcctaggtcagcccaaggctgccccctcggtcactc

SEQ ID NO: 536233 - DNA, 505 bp, Homo sapiens
  misc_feature: HIJSMM301BKHMR.48.25.C03.1.454.light.4.raw
agtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgcc

SEQ ID NO: 536234 - DNA, 488 bp, Homo sapiens; identical to SEQ ID NO: 535861
  misc_feature: HIJSMM301DHE3V.14.55.E11.1.454.light.4.raw

SEQ ID NO: 536235 - DNA, 504 bp, Homo sapiens
  misc_feature: HIJSMM301EHXNE.2.71.G05.1.454.light.4.raw
acgctcgacacacgaccggtgctcgatttagtgtcgtcgcaagagagagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcact

SEQ ID NO: 536236 - DNA, 485 bp, Homo sapiens
  misc_feature: HIJSMM301ED977.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatacagcagagtggaggctgaggatgttgggctctattattgcatgcaagctctacaagtcccgctcactttcggcggagggaccaaggtggagatcaaacgaa

SEQ ID NO: 536237 - DNA, 530 bp, Homo sapiens
  misc_feature: HIJSMM301CVOSM.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggtccgaacgggaccgaaaggtgggaaaagtaccaaaacggaaacctagtgggctggccaccaactccttgtctttctatctttcccccg

SEQ ID NO: 536238 - DNA, 489 bp, Homo sapiens
  misc_feature: HIJSMM301EC3O3.12.51.E07.1.454.light.4.raw
atacgacgtacacgaccggtgctcgatttagcatactctacaacacacaaaggggcaggagtcagacccagtcaggacacagcatggacatgagggtccccgctcagctcctggggctcctgctgctctggctcccaggtgccgcatggcgacgatccgtgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtgggtcccatcaaggttcagcggcagtgggtctgggacagaattcactctcaccatcagcagcctgcaacctgatgactttgcaacttattactgccaacagtataatggttatgaatccacttttggccaagggccaagctggagatcaaacgaactgtggctgcacca

SEQ ID NO: 536239 - DNA, 485 bp, Homo sapiens; identical to SEQ ID NO: 535501
  misc_feature: HIJSMM301AG8WF.3.10.A10.1.454.light.4.raw

SEQ ID NO: 536240 - DNA, 495 bp, Homo sapiens
  misc_feature: HIJSMM301DJVWW.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagaattaaacgaactgtggctgcaccatctgtt

SEQ ID NO: 536241 - DNA, 444 bp, Homo sapiens; identical to SEQ ID NO: 535411
  misc_feature: HIJSMM301BC1QJ.8.73.G07.1.454.light.4.raw

SEQ ID NO: 536242 - DNA, 474 bp, Homo sapiens
  misc_feature: HIJSMM301DKIE8.48.40.D07.1.454.light.4.raw
agtatacatacacgaccggtgctcgatttagtgatagagcgtaacaacagaggggactgatcaggactcctcagttcaccttctcacaatgaggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttgggttctaatcgggcctccggggtccctgacaggttcagtggccatggatcaggcacagatttcacactgaaaatcagcagagtggaggctgaggatgttggagtttactactgcatgcaagctctgcatactgctcggacgttcgcaaggaccaagtggag

SEQ ID NO: 536243 - DNA, 469 bp, Homo sapiens
  misc_feature: HIJSMM301A3IHY.26.78.H01.1.454.light.4.raw
agactatactcacgaccggtgctcgatttagtgtgagtagtttgggtttggggaggaactgctcagttaggacccacgagggaaccatggaagccccacgctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcgggagggaccagggtggagatcagacgaactgtggctgcaccatctgtcttccatcttccccgccatctgaaggtatagtct

SEQ ID NO: 536244 - DNA, 447 bp, Homo sapiens; identical to SEQ ID NO: 535020
  misc_feature: HIJSMM301DA1U5.18.9.A09.1.454.light.4.raw

SEQ ID NO: 536245 - DNA, 484 bp, Homo sapiens
  misc_feature: HIJSMM301AY5HK.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctggaccaaacgtggatatcaaacgaactgtggctgcacatctgt

SEQ ID NO: 536246 - DNA, 493 bp, Homo sapiens
  misc_feature: HIJSMM301BF9I5.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttcccg

SEQ ID NO: 536247 - DNA, 515 bp, Homo sapiens
  misc_feature: HIJSMM301AX59D.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccgccctcctcg

SEQ ID NO: 536248 - DNA, 496 bp, Homo sapiens
  misc_feature: HIJSMM301AXA7G.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtggctgcacc

SEQ ID NO: 536249 - DNA, 492 bp, Homo sapiens
  misc_feature: HIJSMM301BO7RN.49.68.G02.1.454.light.4.raw
agtcgagagacacgaccggtgctcgatttagtcgatagtgaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtctt

SEQ ID NO: 536250 - DNA, 499 bp, Homo sapiens
  misc_feature: HIJSMM301D4OJC.8.2.A02.1.454.light.4.raw
ctcgcgtgtccacgaccggtgctcgatttagactcatctacagggggaggaactgctcagttaggacccagagggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcagcagcgtagcaactggcctttcactttcggcccggggaccaaagtggatatcaaacgaactgtggctgcaccatctgtcttcatcttcccgccat

SEQ ID NO: 536251 - DNA, 494 bp, Homo sapiens; identical to SEQ ID NO: 535680
  misc_feature: HIJSMM301CM904.16.78.H01.1.454.light.4.raw

SEQ ID NO: 536252 - DNA, 498 bp, Homo sapiens; identical to SEQ ID NO: 536173
  misc_feature: HIJSMM301A3E02.12.86.H09.1.454.light.4.raw

SEQ ID NO: 536253 - DNA, 502 bp, Homo sapiens
  misc_feature: HIJSMM301C7EPF.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaa

SEQ ID NO: 536254 - DNA, 505 bp, Homo sapiens
  misc_feature: HIJSMM301CW8J2.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtctt

SEQ ID NO: 536255 - DNA, 481 bp, Homo sapiens
  misc_feature: HIJSMM301A1KCS.10.53.E09.1.454.light.4.raw
catagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaaacgaa

SEQ ID NO: 536256 - DNA, 424 bp, Homo sapiens
  misc_feature: HIJSMM301BPFPZ.9.34.D01.1.454.light.4.raw
tgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggcccaaccccactgtcactctgttccccaccctcctcagacgtatca

SEQ ID NO: 536257 - DNA, 493 bp, Homo sapiens; identical to SEQ ID NO: 535084
  misc_feature: HIJSMM301DJRME.47.64.F09.1.454.light.4.raw

SEQ ID NO: 536258 - DNA, 507 bp, Homo sapiens
  misc_feature: HIJSMM301DXM7R.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtctacgtcagcccaaggccaacccactgtcactctgttcccg

SEQ ID NO: 536259 - DNA, 481 bp, Homo sapiens; identical to SEQ ID NO: 535061
  misc_feature: HIJSMM301BMYQL.16.81.H04.1.454.light.4.raw

SEQ ID NO: 536260 - DNA, 494 bp, Homo sapiens; identical to SEQ ID NO: 534994
  misc_feature: HIJSMM301A51ZK.27.78.H01.1.454.light.4.raw

SEQ ID NO: 536261 - DNA, 486 bp, Homo sapiens
  misc_feature: HIJSMM301CDY0E.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccaggggaccaagctggagatcacaggaactgtggctgcacc

SEQ ID NO: 536262 - DNA, 517 bp, Homo sapiens
  misc_feature: HIJSMM301AF9I6.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaacccactgtcactctcg

SEQ ID NO: 536263 - DNA, 485 bp, Homo sapiens
  misc_feature: HIJSMM301AOB3K.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccaccctcctctacgtgagct

SEQ ID NO: 536264 - DNA, 489 bp, Homo sapiens
  misc_feature: HIJSMM301EENYW.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtccctcaaggttcagcggcagtggatctgggacagatttcactctcgccatcagcagcctgcagactgaagattttgcaacttattttgttcaacaggctaacactttcccctcacttcggtcggagggaccaaggtggagatcaagcgaactgtggctgcaccatctgtctt

SEQ ID NO: 536265 - DNA, 518 bp, Homo sapiens
  misc_feature: HIJSMM301AJ4XF.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctcctactctggctcccagataccaccggagaaactgtgttgacacagtctccaggcaccctgtctttgtctccggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaacgggaccgaacggtagggaagtacgaaacgaactacgtggcgtgcaccatctgtcttctatcttcccgtcccact

SEQ ID NO: 536266 - DNA, 499 bp, Homo sapiens
  misc_feature: HIJSMM301C6BNY.47.66.F11.1.454.light.4.raw
agctcacgtacacgaccggtgctcgatttagtcacgcgagaaggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttattactgtcagcagcgtaacaattggccgatcaccttcggccaagggacacgactggagattaaacgaactgtggctgcaccatctgtcttcatcttcccgccat

SEQ ID NO: 536267 - DNA, 499 bp, Homo sapiens
  misc_feature: HIJSMM301BV3BK.43.41.D08.1.454.light.4.raw
tgtgagtagtcacgaccggtgctcgatttagtcacgcgagaaagggaaagggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcacc

SEQ ID NO: 536268 - DNA, 484 bp, Homo sapiens
  misc_feature: HIJSMM301AURYB.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccaggcaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccat

SEQ ID NO: 536269 - DNA, 507 bp, Homo sapiens
  misc_feature: HIJSMM301CYR5K.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactctgttccca

SEQ ID NO: 536270 - DNA, 469 bp, Homo sapiens
  misc_feature: HIJSMM301C5C0U.19.74.G08.1.454.light.4.raw
tactctcgtgcacgaccggtgctcgatttagtagctctatcagggtgctgctaatgctctgggcccctggatccagtggggatattgtgatgacccaggctccactctcctcacctgtcacccttggacagccggcctccatctcctgcacttctagccaaaacctcgtgcacagtgatggaaacacctacttgagttggcttcagcagaggccaggccagcctccaagactcctaatctctaagatttctaaccggttctctggggtcccagacagattcagtggcagtggggcaggggcagatttcacactgagaatcagcagggtggaacctgaggatgtcgcgatttatactgcatgcaagctacacattttcctcgaacttttggccaggggaccaggctggagatcaagcgaactgtggctgcaccatctgtcttcatcttcccgccatctgacacgagagta

SEQ ID NO: 536271 - DNA, 514 bp, Homo sapiens
  misc_feature: HIJSMM301B9LE1.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgccgacggaccgaacggtaggaagtacgaacgaactagtggcgtgcaccactctgtcttctactcttcccgtcccact

SEQ ID NO: 536272 - DNA, 487 bp, Homo sapiens
  misc_feature: HIJSMM301AGZNR.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatctgtt

SEQ ID NO: 536273 - DNA, 493 bp, Homo sapiens
  misc_feature: HIJSMM301BNQXJ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaacaccttcggccaagggacacgactggagattaaaggaactgtggctgcaccatctgtcttcatcttccccg

SEQ ID NO: 536274 - DNA, 509 bp, Homo sapiens
  misc_feature: HIJSMM301DOE4D.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccgaacgggaccgaaggtaggaaagtacaaacgaactagtggctgcaccatctgtcttctatcttccccg

SEQ ID NO: 536275 - DNA, 383 bp, Homo sapiens; identical to SEQ ID NO: 447524
  misc_feature: HIJSMM301A6J9V.41.26.C04.1.454.light.4.raw

SEQ ID NO: 536276 - DNA, 452 bp, Homo sapiens
  misc_feature: HIJSMM301AMYDF.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctggaccgaaggtcaccgtcctaagtcagcccaacggccaacccctcctcgtcactctgttcccgtccctcctccactactcgta

SEQ ID NO: 536277 - DNA, 418 bp, Homo sapiens
  misc_feature: HIJSMM301DWZH6.19.86.H09.1.454.light.4.raw
tactctcgtgcacgaccggtgctcgatttagtgctatagacttgggtttgggggccgttcctgggactttctgataccacatcacaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 536278 - DNA, 492 bp, Homo sapiens
  misc_feature: HIJSMM301BIDBU.13.11.A11.1.454.light.4.raw
tcacgtactacacgaccggtgctcgatttagctacgactgcagggggaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaagagccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcat

SEQ ID NO: 536279 - DNA, 503 bp, Homo sapiens
  misc_feature: HIJSMM301AHUOH.40.45.E01.1.454.light.4.raw
tctagcgactcacgaccggtgctcgatttagtgagtcagtaagggaaaggggaggaactgctcagttaggacccagagggaaccatggaagccccagctcagcttctcttcctcctgctactctggctcccagtaatcaccggagaaattgtgttgacacagtctccagccaccctgtccttctctccaggggaaagagcctccctctcctgcagggccagtcagagtattaataccttcttggcctggtaccagcaaaagcctggccaggctcccagactcctcatctatgatgcatccaacagggccactggcgtcccggccaggttcagtggcagtgggtctgggacagacttcactctcaccatcagcagcctagagcctgaagattttgcagtttattactgtcagcagcgtgccaactggcctctcactttcggcggagggaccgaaggtggagatacaaacgaactgtggctgcaccatctgtcttcatcttcccg

SEQ ID NO: 536280 - DNA, 335 bp, Homo sapiens
  misc_feature: HIJSMM301CXLZ6.43.36.D03.1.454.light.4.raw
tgtgagtagtcacgaccggtgctcgatttagctgcgtcacgatctctcttgggatagaagttattcagcaggcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttggtgctccgtacacttttggccaggggaccaagttggagatcaaacgaactgtggctgcaccatctgtcttcatcttcccgccatctgaacactcaca

SEQ ID NO: 536281 - DNA, 447 bp, Homo sapiens; identical to SEQ ID NO: 535201
  misc_feature: HIJSMM301D35LM.18.9.A09.1.454.light.4.raw

SEQ ID NO: 536282 - DNA, 488 bp, Homo sapiens
  misc_feature: HIJSMM301AYILP.47.48.E04.1.454.light.4.raw
agctcacgtacacgaccggtgctcgatttagagagcgtcacagagagaaggggaatcagtcccactcaggacacagcatggacatgagggtcccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccagggaccgaacggtaggaaagtacaaacgaactagtggctgtcacca

SEQ ID NO: 536283 - DNA, 493 bp, Homo sapiens
  misc_feature: HIJSMM301BITLF.5.11.A11.1.454.light.4.raw
atcagacacgcacgaccggtgctcgatttagctacgactgcaggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttctgcatgcaaggtacacactggccgtacacttttggccaggggaccaagctggagatcaaacgaactgtggctgcacca

SEQ ID NO: 536284 - DNA, 491 bp, Homo sapiens
  misc_feature: HIJSMM301A08WG.53.11.A11.1.454.light.4.raw
cgcgtatacacacgaccggtgctcgatttagctacgactgcagggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggt

SEQ ID NO: 536285 - DNA, 504 bp, Homo sapiens
  misc_feature: HIJSMM301BDD2M.47.55.E11.1.454.light.4.raw
agctcacgtacacgaccggtgctcgatttagcactcgcacgtagggtcttgggcccagtctgtgctgactcagccaccctcagcgtctgggacccccggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagccccaaggccaacccccactgtcactctgttcccgccctcctcta

SEQ ID NO: 536286 - DNA, 447 bp, Homo sapiens; identical to SEQ ID NO: 535201
  misc_feature: HIJSMM301DTLBN.18.9.A09.1.454.light.4.raw

SEQ ID NO: 536287 - DNA, 453 bp, Homo sapiens
  misc_feature: HIJSMM301A17RP.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctcctccacgagagta

SEQ ID NO: 536288 - DNA, 463 bp, Homo sapiens; identical to SEQ ID NO: 535062
  misc_feature: HIJSMM301ATGBL.11.73.G07.1.454.light.4.raw

SEQ ID NO: 536289 - DNA, 493 bp, Homo sapiens
  misc_feature: HIJSMM301C76NO.14.5.A05.1.454.light.4.raw
cgtctagtaccacgaccggtgctcgatttagatagatagacaggggggaactgctcagttaggacccagagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctcctgcgctcactttcggcggagggaccaaggtggagatcaaacgaactgtggctgcaccatctgtcttcta

SEQ ID NO: 536290 - DNA, 496 bp, Homo sapiens
  misc_feature: HIJSMM301A5PCX.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccgaagctggagatcaaccgaactagtggctgcaccatctgtt

SEQ ID NO: 536291 - DNA, 441 bp, Homo sapiens
  misc_feature: HIJSMM301BIT2L.11.3.A03.1.454.light.4.raw
cgagagataccacgaccggtgctcgatttagagagcgtcacatggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcatttggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 536292 - DNA, 501 bp, Homo sapiens
  misc_feature: HIJSMM301C277F.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcaccagccttcaggctgaagatgtggcagtttattactgtcaccaatatttagacattcctccgacgttcagccaagggaccaaggtggagatcaaacgaactgtggctgcaccatctgtctt

SEQ ID NO: 536293 - DNA, 463 bp, Homo sapiens; identical to SEQ ID NO: 535062
  misc_feature: HIJSMM301CRZIG.11.73.G07.1.454.light.4.raw

SEQ ID NO: 536294 - DNA, 491 bp, Homo sapiens
  misc_feature: HIJSMM301AN1V1.15.67.G01.1.454.light.4.raw
tctacgtagccacgaccggtgctcgatttagagtatacatattgggtttgggggcgaggagtcagacccacctcagtacacagcatggacatgagggtccccgcctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattacccctcggacgttcggtccacggggaccgaaggtagggaatacaaacgaaacctgtggc

SEQ ID NO: 536295 - DNA, 491 bp, Homo sapiens
  misc_feature: HIJSMM301BULXM.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttgccgggggaccaagctggaatcaagcgaactgtggctgcaccatctgtcttcatt

SEQ ID NO: 536296 - DNA, 493 bp, Homo sapiens
  misc_feature: HIJSMM301BX42J.5.48.E04.1.454.light.4.raw
atcagacacgcacgaccggtgctcgatttagagagcgtcacagagagaaggggctggagaagagctgctcagttaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagactttgcgctgtatttctgtcagcagtatgttttcgcacctttcactttcggcggagggaccaaggtggagagcagacgaactgtggctgcacca

SEQ ID NO: 536297 - DNA, 507 bp, Homo sapiens
  misc_feature: HIJSMM301AUULI.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattagagatcaaacgaactgtggctgcaccatctgtcttcatcttcccgccat

SEQ ID NO: 536298 - DNA, 447 bp, Homo sapiens; identical to SEQ ID NO: 535020
  misc_feature: HIJSMM301CDMGU.18.9.A09.1.454.light.4.raw

SEQ ID NO: 536299 - DNA, 493 bp, Homo sapiens
  misc_feature: HIJSMM301A8MYA.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggcctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtcctaggtcagcccaaggctgccccctcggtcta

SEQ ID NO: 536300 - DNA, 504 bp, Homo sapiens
  misc_feature: HIJSMM301AZOVR.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccaaggtggaggtcaaacgaactgtggctgcaccatctgtcttcta

SEQ ID NO: 536301 - DNA, 528 bp, Homo sapiens
  misc_feature: HIJSMM301C52PB.12.53.E09.1.454.light.4.raw
atacgacgtacacgaccggtgctcgatttagagagagtgtgttgggtttgggggctggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactacatgatttatgagggcactaagcggccctcaggggtttcgttatcgcttctctggctccgagtctggcaacacggcctccctcgacaatctctgggcgtccaggctgaggacgaggcggattattactgttgctcatatgcgggtagtagcactttcgtatgttcctattcggtcggagggaccgaacgcgtgaccgtcctcgggtcgagcccaacggacgtcgccccctccc

SEQ ID NO: 536302 - DNA, 472 bp, Homo sapiens
  misc_feature: HIJSMM301BAWWL.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccaaggtggacatcaaacgaa

SEQ ID NO: 536303 - DNA, 493 bp, Homo sapiens
  misc_feature: HIJSMM301E2POU.16.68.G02.1.454.light.4.raw
  modified_base (482)..(482): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcgtggaggaccaaggtggaggtcaaacgaaactgtggcgtgcaccaacnctgtcttctat

SEQ ID NO: 536304 - DNA, 509 bp, Homo sapiens
  misc_feature: HIJSMM301BGXFA.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgccat

SEQ ID NO: 536305 - DNA, 480 bp, Homo sapiens
  misc_feature: HIJSMM301CV64Y.46.35.D02.1.454.light.4.raw
actagcagtacacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaactttggccagggaccagctgagatcaacgaactgtggctgcaccat

SEQ ID NO: 536306 - DNA, 482 bp, Homo sapiens
  misc_feature: HIJSMM301BHBOP.52.86.H09.1.454.light.4.raw
  modified_base (398)..(398): a, c, t, g, unknown or other
  modified_base (435)..(435): a, c, t, g, unknown or other
cgcagtacgacacgaccggtgctcgatttagtgctatagacttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcagggggacgtatccctgatcgcttctcaggctccggctctgggactgagcgctacctcaccatctccagcctccagtctgaggacgagggtnactattactgtcagacgtgggacactggcatttgggngttcggcggagggaccaagttgaccgtctaggtcagcccaaggctcg

SEQ ID NO: 536307 - DNA, 485 bp, Homo sapiens
  misc_feature: HIJSMM301DZ5BY.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaacgaactgtggctgcaccat

SEQ ID NO: 536308 - DNA, 444 bp, Homo sapiens; identical to SEQ ID NO: 535192
  misc_feature: HIJSMM301C97UK.5.9.A09.1.454.light.4.raw

SEQ ID NO: 536309 - DNA, 487 bp, Homo sapiens; identical to SEQ ID NO: 535508
  misc_feature: HIJSMM301BMSFV.13.87.H10.1.454.light.4.raw

SEQ ID NO: 536310 - DNA, 486 bp, Homo sapiens; identical to SEQ ID NO: 535385
  misc_feature: HIJSMM301B8E6I.19.71.G05.1.454.light.4.raw

SEQ ID NO: 536311 - DNA, 495 bp, Homo sapiens
  misc_feature: HIJSMM301DINYR.49.58.F03.1.454.light.4.raw
agtcgagagacacgaccggtgctcgatttagtctgatcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctccctgtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttccccg

SEQ ID NO: 536312 - DNA, 484 bp, Homo sapiens
  misc_feature: HIJSMM301DVLTK.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccagggaccaaactggatatcagacgaactgtgg

SEQ ID NO: 536313 - DNA, 503 bp, Homo sapiens
  misc_feature: HIJSMM301A9V1H.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagccccaa

SEQ ID NO: 536314 - DNA, 497 bp, Homo sapiens; identical to SEQ ID NO: 534982
  misc_feature: HIJSMM301B5FV5.26.80.H03.1.454.light.4.raw

SEQ ID NO: 536315 - DNA, 493 bp, Homo sapiens; identical to SEQ ID NO: 535745
  misc_feature: HIJSMM301D50X7.47.78.H01.1.454.light.4.raw

SEQ ID NO: 536316 - DNA, 495 bp, Homo sapiens
  misc_feature: HIJSMM301A4DQT.40.23.C01.1.454.light.4.raw
tctagcgactcacgaccggtgctcgatttagtacacgtgattagggattggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcat

SEQ ID NO: 536317 - DNA, 506 bp, Homo sapiens; identical to SEQ ID NO: 534969
  misc_feature: HIJSMM301DTTWR.18.37.D04.1.454.light.4.raw

SEQ ID NO: 536318 - DNA, 490 bp, Homo sapiens
  misc_feature: HIJSMM301C27MD.49.45.E01.1.454.light.4.raw
agtcgagagacacgaccggtgctcgatttagtgagtcagtaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccgggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcgagggaccaaggtggagatcaaacgaactgtggctgcaccatctgtcttca

SEQ ID NO: 536319 - DNA, 447 bp, Homo sapiens; identical to SEQ ID NO: 535020
  misc_feature: HIJSMM301CZ6U6.18.9.A09.1.454.light.4.raw

SEQ ID NO: 536320 - DNA, 495 bp, Homo sapiens
  misc_feature: HIJSMM301B4Y8Q.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggaggattaaaggaactgtggctgcaccatctgtcttcatcttccccg

SEQ ID NO: 536321 - DNA, 471 bp, Homo sapiens
  misc_feature: HIJSMM301C0J8J.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctgtcttcatcttccgccat

SEQ ID NO: 536322 - DNA, 505 bp, Homo sapiens
  misc_feature: HIJSMM301BH6VL.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggcgtgcaccatctgtt

SEQ ID NO: 536323 - DNA, 486 bp, Homo sapiens
  misc_feature: HIJSMM301CRMNQ.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagattttgcagtttattactgtcagcagtataatagctggcccgcgacgttcggccaagggaccgaggtggaattcaaacgaactgtggctgcaccatctgtctt

SEQ ID NO: 536324 - DNA, 485 bp, Homo sapiens
  misc_feature: HIJSMM301CEFA8.43.50.E06.1.454.light.4.raw
tgtgagtagtcacgaccggtgctcgatttagatctactgacaacacacaagggggcaggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggacctatctaaattggtatcagcagaaaccagggaaagtccctgaggtcctcatctatggtgcatccagtttgccaagtggggtcccagcaaggttcagtggcagtggatctgggacagatttcactctcaccatcagcagtctacaacctgaagattttgcaacttactactgtcaacagagtttcagtacccctctgacgttcggccaagggaccaaggtggaaataaacgaactagtggctgca

SEQ ID NO: 536325 - DNA, 454 bp, Homo sapiens
  misc_feature: HIJSMM301DJL7F.19.86.H09.1.454.light.4.raw
  modified_base (436)..(436): a, c, t, g, unknown or other
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccnccctcctccacgagagta

SEQ ID NO: 536326 - DNA, 496 bp, Homo sapiens
  misc_feature: HIJSMM301EKUGB.16.12.B01.1.454.light.4.raw
tgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcagcggggcccagactatggatgaggctgactattactgtcaggcgtgggacagcaattctgtgattttcggcggagggaccaagttgaccgtcctaggtcagcccaaggctgccccctcggtcactctcg

SEQ ID NO: 536327 - DNA, 502 bp, Homo sapiens
  misc_feature: HIJSMM301E082Z.48.71.G05.1.454.light.4.raw
agtatacatacacgaccggtgctcgatttagtgtcgtcgcaagagagaggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgttttctgtcagcagtatggaagttcacctcggacattcggccaggggaccaaggtggaaatcaaacgaactgtggctgcaccatctgtcttcatcttcccg

SEQ ID NO: 536328 - DNA, 516 bp, Homo sapiens
  misc_feature: HIJSMM301C402I.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctcctactctggctcccagataccaccggagaaactgtgttgacacagtctccaggcaccctgtctttgtctccggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaagggaccgaacggtaggaaggtcaaacgaaactagtggcgtcgcaccactctgtcttctatcttcccgtccact

SEQ ID NO: 536329 - DNA, 486 bp, Homo sapiens
  misc_feature: HIJSMM301ENKGE.21.4.A04.1.454.light.4.raw
tcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaagggaccaaggtagaaatgaaacgaactgtggctgcaccat

SEQ ID NO: 536330 - DNA, 497 bp, Homo sapiens
  misc_feature: HIJSMM301D8PFS.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatgcaggcatcaacactgttttcggcggagggaccaagctgaccgtcctaggtcagcccaaggctgccccctcggtccactctgttcccaccctcctcgagtgcgtct

SEQ ID NO: 536331 - DNA, 467 bp, Homo sapiens
  misc_feature: HIJSMM301C9PRJ.48.47.E03.1.454.light.4.raw
agtatacatacacgaccggtgctcgatttagactcgcgcacagagagaagggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 536332 - DNA, 489 bp, Homo sapiens; identical to SEQ ID NO: 535386
  misc_feature: HIJSMM301D64SJ.12.51.E07.1.454.light.4.raw

SEQ ID NO: 536333 - DNA, 494 bp, Homo sapiens
  misc_feature: HIJSMM301CINDE.47.60.F05.1.454.light.4.raw
  modified_base (482)..(482): a, c, t, g, unknown or other
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaaacagcctgcagtctgaagattttgcagtttattatgtcagcagtatcatgactggccgctcaaccttcggtccaacggacgagactaggagattaaacgaactaagtaggngtgcgcacactc

SEQ ID NO: 536334 - DNA, 415 bp, Homo sapiens; identical to SEQ ID NO: 536118
  misc_feature: HIJSMM301D76OE.18.78.H01.1.454.light.4.raw

SEQ ID NO: 536335 - DNA, 473 bp, Homo sapiens; identical to SEQ ID NO: 535262
  misc_feature: HIJSMM301DOLU5.8.67.G01.1.454.light.4.raw

SEQ ID NO: 536336 - DNA, 491 bp, Homo sapiens
  misc_feature: HIJSMM301AP1NB.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggcccccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtggggtctgggacagacttcactctcaccatcagcagactggagcctgaagattttgcagtctattactgtcagcagtatggtcacgtcccaagaacttttggccaggggaccaagctggagatcaaacgaactgtggctgcaccatctgt

SEQ ID NO: 536337 - DNA, 485 bp, Homo sapiens
  misc_feature: HIJSMM301CG86L.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcgggtttattactgcatgcagggtacagtgtggccttcgctcgcattcggcggagggccaaggtggagatcaacgaa

SEQ ID NO: 536338 - DNA, 353 bp, Homo sapiens
  misc_feature: HIJSMM301EXGPZ.3.11.A11.1.454.light.4.raw
agacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgaactgtggctgcaccatctgtcttcatcttcccgccatctgagagtgcgtct

SEQ ID NO: 536339 - DNA, 509 bp, Homo sapiens
  misc_feature: HIJSMM301BN6VU.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttccc

SEQ ID NO: 536340 - DNA, 434 bp, Homo sapiens
  misc_feature: HIJSMM301A10JF.10.38.D05.1.454.light.4.raw
catagtagtgcacgaccggtgctcgatttagtatctgatagttgggtttggggggtgtggtggtctccactccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccgccctcctccactactatg

SEQ ID NO: 536341 - DNA, 535 bp, Homo sapiens
  misc_feature: HIJSMM301BMWVW.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgccgactacctaccgtccggaaccggaaacggaccaaccgtacggtaggaagttaaacgttaaaaccgtacgttggtcggcgtcgaccaacctattcgttcgttcctactt

SEQ ID NO: 536342 - DNA, 505 bp, Homo sapiens
  misc_feature: HIJSMM301A18XC.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccgggaccaaagtggaaatcaaacgaactgtggctgcaccatctgtcttcatcttcccgc

SEQ ID NO: 536343 - DNA, 495 bp, Homo sapiens
  misc_feature: HIJSMM301AZCOM.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccaggtggaaatcaaacgaactagtggctgcaccatctgtcttcatt

SEQ ID NO: 536344 - DNA, 499 bp, Homo sapiens
  misc_feature: HIJSMM301B2KMI.8.2.A02.1.454.light.4.raw
ctcgcgtgtccacgaccggtgctcgatttagactcatctacagggggaggaactgctcagttaggacccagagggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcagcagcgtagcaactggcctttcactttcggcccggggaccaaagtggaaatcaaacgaactgtggctgcaccatctgtcttcatcttcccgccat

SEQ ID NO: 536345 - DNA, 493 bp, Homo sapiens; identical to SEQ ID NO: 535278
  misc_feature: HIJSMM301CRFWC.51.81.H04.1.454.light.4.raw

SEQ ID NO: 536346 - DNA, 454 bp, Homo sapiens; identical to SEQ ID NO: 534964
  misc_feature: HIJSMM301CXUE2.19.86.H09.1.454.light.4.raw

SEQ ID NO: 536347 - DNA, 454 bp, Homo sapiens
  misc_feature: HIJSMM301CVGW6.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctcctccacgagagta

SEQ ID NO: 536348 - DNA, 509 bp, Homo sapiens
  misc_feature: HIJSMM301DF0HH.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaaatcaaacgaactagtggctgcaccatctgtctt

SEQ ID NO: 536349 - DNA, 495 bp, Homo sapiens
  misc_feature: HIJSMM301DWO5F.9.39.D06.1.454.light.4.raw
tgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaagagccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccatcagcagtctgcagtcggaagattttgcagtttactattgtcagcagtatagtaacgggccgctcactttcggcggagggaccaaggtggagatcaaacgaactgtggctgcaccatctgtcttc

SEQ ID NO: 536350 - DNA, 498 bp, Homo sapiens
  misc_feature: HIJSMM301BZLOL.48.61.F06.1.454.light.4.raw
agtatacatacacgaccggtgctcgatttagctacgctctaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggaccttcggccaagggacacgactggagattaacgaactgtggctgcaccatctgtcttcatcttcccgcca

SEQ ID NO: 536351 - DNA, 417 bp, Homo sapiens
  misc_feature: HIJSMM301DHX5U.41.9.A09.1.454.light.4.raw
tctatactatcacgaccggtgctcgatttagcgagacgcgcagggcacgaccggtgctcgatttagatcgtctgtgttgggtttggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 536352 - DNA, 485 bp, Homo sapiens; identical to SEQ ID NO: 534977
  misc_feature: HIJSMM301A144D.15.28.C06.1.454.light.4.raw

SEQ ID NO: 536353 - DNA, 484 bp, Homo sapiens
  misc_feature: HIJSMM301BU4NZ.52.53.E09.1.454.light.4.raw
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtctaggtcagcccaaggctcg

SEQ ID NO: 536354 - DNA, 447 bp, Homo sapiens; identical to SEQ ID NO: 535020
  misc_feature: HIJSMM301C85VL.18.9.A09.1.454.light.4.raw

SEQ ID NO: 536355 - DNA, 506 bp, Homo sapiens
  misc_feature: HIJSMM301BZVBM.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcact

SEQ ID NO: 536356 - DNA, 490 bp, Homo sapiens
  misc_feature: HIJSMM301B2V0F.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaaggcggagatcagacgaactgtggctgcaccatctgtcttcta

SEQ ID NO: 536357 - DNA, 483 bp, Homo sapiens
  misc_feature: HIJSMM301DUU9S.48.5.A05.1.454.light.4.raw
agtatacatacacgaccggtgctcgatttagatagatagacaggggggagtcagacccagtcaggacacagcatggacatgagggtccccgctcagctcctggggctcctgctgctctggctcccaggtgccaaatgtgacatccagatgacccaggctccttccaccctgtctggatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccaaggtggaaatcaaacgaaactgtggctgcaccatctgt

SEQ ID NO: 536358 - DNA, 506 bp, Homo sapiens; identical to SEQ ID NO: 535404
  misc_feature: HIJSMM301BP1H9.10.88.H11.1.454.light.4.raw

SEQ ID NO: 536359 - DNA, 495 bp, Homo sapiens
  misc_feature: HIJSMM301AIBIU.48.4.A04.1.454.light.4.raw
agtatacatacacgaccggtgctcgatttagagtagtgatcagggggagtcagtctcagtcaggacacagcatggacatgagggtccccgctcagctcctggggctcctgctactctggctccgaggtgccagatgtgacatccagatgacccagtctccatcatccctgtctgcatatgtgggggacagagtcaccatcacttgccgggcaagtcagagcattagtaggtatttaaattggtatcatcaaagaccagggatggcccctaacctcctgatctacggtacatccactttgcaaagtggggtcccctcaaggttcagcggcagtggctcttggacggatttcactctcaccatcaccagtcttcaggctgaagatttaggaatttactactgtcagcagacttacagtgttccgtacacttttggccaggggaccaaactggagatgaaacgaactgtggctgcaccatctgtcttcatcttccccg

SEQ ID NO: 536360 - DNA, 492 bp, Homo sapiens
  misc_feature: HIJSMM301BIT85.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttactgtcagcagtatagtaactggcctccgtacacttttggccaggggaccaagctagaaatcaaacgaactgtggctgcaccatctgtcttc

SEQ ID NO: 536361 - DNA, 489 bp, Homo sapiens; identical to SEQ ID NO: 535139
  misc_feature: HIJSMM301COU3Z.14.55.E11.1.454.light.4.raw

SEQ ID NO: 536362 - DNA, 457 bp, Homo sapiens
  misc_feature: HIJSMM301AFYLV.49.83.H06.1.454.light.4.raw
agtcgagagacacgaccggtgctcgatttagatcacgtgcgtcgcgggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggagtaaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgt

SEQ ID NO: 536363 - DNA, 509 bp, Homo sapiens
  misc_feature: HIJSMM301BSDZV.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccta

SEQ ID NO: 536364 - DNA, 478 bp, Homo sapiens; identical to SEQ ID NO: 535129
  misc_feature: HIJSMM301DIVQN.11.11.A11.1.454.light.4.raw

SEQ ID NO: 536365 - DNA, 494 bp, Homo sapiens; identical to SEQ ID NO: 535629
  misc_feature: HIJSMM301AKIBT.4.27.C05.1.454.light.4.raw

SEQ ID NO: 536366 - DNA, 471 bp, Homo sapiens; identical to SEQ ID NO: 536321
  misc_feature: HIJSMM301D9OIG.15.8.A08.1.454.light.4.raw

SEQ ID NO: 536367 - DNA, 496 bp, Homo sapiens; identical to SEQ ID NO: 535109
  misc_feature: HIJSMM301BWCH9.16.78.H01.1.454.light.4.raw

SEQ ID NO: 536368 - DNA, 484 bp, Homo sapiens; identical to SEQ ID NO: 535240
  misc_feature: HIJSMM301C8ULV.47.60.F05.1.454.light.4.raw

SEQ ID NO: 536369 - DNA, 504 bp, Homo sapiens
  misc_feature: HIJSMM301CI55B.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatggggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaacccccactgtcactctgttcccaccctcctcta

SEQ ID NO: 536370 - DNA, 495 bp, Homo sapiens; identical to SEQ ID NO: 535821
  misc_feature: HIJSMM301BTIUM.3.31.C09.1.454.light.4.raw

SEQ ID NO: 536371 - DNA, 497 bp, Homo sapiens
  misc_feature: HIJSMM301D77JA.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtt

SEQ ID NO: 536372 - DNA, 489 bp, Homo sapiens; identical to SEQ ID NO: 535386
  misc_feature: HIJSMM301APPRR.12.51.E07.1.454.light.4.raw

SEQ ID NO: 536373 - DNA, 491 bp, Homo sapiens
  misc_feature: HIJSMM301AZN4C.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccagggaccaagctggagatcaatcgaactgtgg

SEQ ID NO: 536374 - DNA, 491 bp, Homo sapiens
  misc_feature: HIJSMM301DCNLJ.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgcttcatcttcccgccat

SEQ ID NO: 536375 - DNA, 501 bp, Homo sapiens
  misc_feature: HIJSMM301DPBEP.48.27.C05.1.454.light.4.raw
agtatacatacacgaccggtgctcgatttagacgcgatcgaagggtttggggagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccg

SEQ ID NO: 536376 - DNA, 497 bp, Homo sapiens
  misc_feature: HIJSMM301B5VKF.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctgcaccatctgtcttcatcttccccg

SEQ ID NO: 536377 - DNA, 468 bp, Homo sapiens
  misc_feature: HIJSMM301AE28E.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactatgtcaacaggctgacagtctcccgctcactttcggcggagggaccgaaggtggagatcaacgaa

SEQ ID NO: 536378 - DNA, 484 bp, Homo sapiens
  misc_feature: HIJSMM301AUP2M.47.60.F05.1.454.light.4.raw
agctcacgtacacgaccggtgctcgatttagtacgtcatcagggaaaggggaggaactgctcagttaggacccagacggaaccatggaagccccacgcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 536379 - DNA, 500 bp, Homo sapiens
  misc_feature: HIJSMM301EWXHH.43.34.D01.1.454.light.4.raw
tgtgagtagtcacgaccggtgctcgatttagatcgtctgtgttgggtttggggctttgcctgggctctgctgctcctcactctcctcgctcaggacacagggtcctgggcccagtctgccctgactcagcctgtctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccactgtcactctgttccccaccctcctcactactcacac

SEQ ID NO: 536380 - DNA, 513 bp, Homo sapiens; identical to SEQ ID NO: 535244
  misc_feature: HIJSMM301B7TTW.17.33.C11.1.454.light.4.raw

SEQ ID NO: 536381 - DNA, 447 bp, Homo sapiens; identical to SEQ ID NO: 535020
  misc_feature: HIJSMM301C2EBP.18.9.A09.1.454.light.4.raw

SEQ ID NO: 536382 - DNA, 464 bp, Homo sapiens
  misc_feature: HIJSMM301AU683.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagtgctgccccgctcagtttcggcggagggaccaaggtggagata

SEQ ID NO: 536383 - DNA, 511 bp, Homo sapiens
  misc_feature: HIJSMM301CX4H8.48.27.C05.1.454.light.4.raw
agtatacatacacgaccggtgctcgatttagacgcgatcgaagggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccaaggtggaggtcaaacgaactgtggctgcaccactctcgttctct

SEQ ID NO: 536384 - DNA, 471 bp, Homo sapiens
  misc_feature: HIJSMM301B2KTB.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcgggggaccaaggtggacatcaaacgaa

SEQ ID NO: 536385 - DNA, 504 bp, Homo sapiens
  misc_feature: HIJSMM301BDJHL.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaaacg

SEQ ID NO: 536386 - DNA, 417 bp, Homo sapiens
  misc_feature: HIJSMM301CNP8L.18.78.H01.1.454.light.4.raw
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaggcaccagcactctctatgtcttcggaactgggaccaaggtcaccgtcctaggtcagcccaaggccaacccactgtcactctgttcccgccctcctccatactcgta

SEQ ID NO: 536387 - DNA, 456 bp, Homo sapiens
  misc_feature: HIJSMM301EGW42.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctcccagtctgaagatgaggctgattattactgtgcaatctgggatgacagtgtgaacggtccggttttcggcggagggaccaagctgaccgtcctaagtcagcccaaggctgccccctccggtcactctgttcccaccctcctccacgagagta

SEQ ID NO: 536388 - DNA, 508 bp, Homo sapiens
  misc_feature: HIJSMM301BWU71.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgcc

SEQ ID NO: 536389 - DNA, 486 bp, Homo sapiens
  misc_feature: HIJSMM301BVVXO.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttatactgcatgcaagctctacaaactccttacacttttggccaggggaccaagctggagatcaaacgaa

SEQ ID NO: 536390 - DNA, 497 bp, Homo sapiens
  misc_feature: HIJSMM301CGVQ0.51.14.B03.1.454.light.4.raw
cgatcgtatacacgaccggtgctcgatttagtgtgagtagttccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 536391 - DNA, 447 bp, Homo sapiens; identical to SEQ ID NO: 535201
  misc_feature: HIJSMM301DRTXD.18.9.A09.1.454.light.4.raw

SEQ ID NO: 536392 - DNA, 454 bp, Homo sapiens
  misc_feature: HIJSMM301DSEYZ.19.71.G05.1.454.light.4.raw
tactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgcaccatctgtcttcatcttcccgccatctgacacgagagta

SEQ ID NO: 536393 - DNA, 484 bp, Homo sapiens
  misc_feature: HIJSMM301AG0H1.4.41.D08.1.454.light.4.raw
agcactgtagcacgaccggtgctcgatttagtcacgcgagaaagggaaagggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaacttactattgtcagagttctaattctttcccgcgcacgtttggccaggggaccaaggtagagatcaaacgaactgtggctgcaccat

SEQ ID NO: 536394 - DNA, 499 bp, Homo sapiens
  misc_feature: HIJSMM301B2D15.19.78.H01.1.454.light.4.raw
tactctcgtgcacgaccggtgctcgatttagtgtgagtagtttgggtttggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctcgttcccgccctcctccacgagagta

SEQ ID NO: 536395 - DNA, 484 bp, Homo sapiens
  misc_feature: HIJSMM301A08VW.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaactttggccagggaccaagctggagatcaaacgaactgtggctgcaccat

SEQ ID NO: 536396 - DNA, 497 bp, Homo sapiens
  misc_feature: HIJSMM301CC617.16.49.E05.1.454.light.4.raw
tgtactactccacgaccggtgctcgatttagagcgactagcaacacacaaagggggggtcgacaagaggcagcgctctcgggacggtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttagtaaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggcggagggaccaaggtgaccgtcctaggtcagcccaaggct

SEQ ID NO: 536397 - DNA, 513 bp, Homo sapiens
  misc_feature: HIJSMM301AM3YR.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgttgcctcctatgagctgactcagccactctcagtgtcagtggccccgggacagacggccaggattacctggtgggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaaccccactgtcactctgttcccaccctcctcga

SEQ ID NO: 536398 - DNA, 466 bp, Homo sapiens
  misc_feature: HIJSMM301BZN4C.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccaaggtggagatcaaacgaa

SEQ ID NO: 536399 - DNA, 504 bp, Homo sapiens
  misc_feature: HIJSMM301CGJ8S.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagatttttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctggtca

SEQ ID NO: 536400 - DNA, 446 bp, Homo sapiens
  misc_feature: HIJSMM301CVNAT.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtctaagtcagcccaaggccaacccctctgtcactctgttcccgccctcctccatactcgta

SEQ ID NO: 536401 - DNA, 494 bp, Homo sapiens; identical to SEQ ID NO: 534992
  misc_feature: HIJSMM301CKRX0.9.1.A01.1.454.light.4.raw

SEQ ID NO: 536402 - DNA, 444 bp, Homo sapiens; identical to SEQ ID NO: 535594
  misc_feature: HIJSMM301A29L0.9.9.A09.1.454.light.4.raw

SEQ ID NO: 536403 - DNA, 513 bp, Homo sapiens
  misc_feature: HIJSMM301COZ22.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtccttggtcagcccaaggctgccccctcggtcactctgttcccaccct

SEQ ID NO: 536404 - DNA, 490 bp, Homo sapiens
  misc_feature: HIJSMM301A1IOJ.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcagggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtcactctgttcccaccctcctctacgtgagct

SEQ ID NO: 536405 - DNA, 505 bp, Homo sapiens
  misc_feature: HIJSMM301D7NHV.9.12.B01.1.454.light.4.raw
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgccgtacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcggccgaaggaccgaaggtggaaatcaaacgaactagtggctgcaccatctgtcttcatcttccccg

SEQ ID NO: 536406 - DNA, 493 bp, Homo sapiens; identical to SEQ ID NO: 535047
  misc_feature: HIJSMM301EEMMH.16.53.E09.1.454.light.4.raw

SEQ ID NO: 536407 - DNA, 500 bp, Homo sapiens
  misc_feature: HIJSMM301AKNGC.43.34.D01.1.454.light.4.raw
tgtgagtagtcacgaccggtgctcgatttagatcgtctgtgttgggtttgggggctttgcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccactgtcactctgttcccaccctcctcactactcacac

SEQ ID NO: 536408 - DNA, 491 bp, Homo sapiens
  misc_feature: HIJSMM301DSCIQ.12.51.E07.1.454.light.4.raw
  modified_base (487)..(487): a, c, t, g, unknown or other
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatggcgacatccgtgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgnacca

SEQ ID NO: 536409 - DNA, 484 bp, Homo sapiens
  misc_feature: HIJSMM301AFR8X.5.39.D06.1.454.light.4.raw
atcagacacgcacgaccggtgctcgatttagtgacatctcgcagttctttggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggcccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccgaaggtcgaaatagagacgaactgtggctgcaccat

SEQ ID NO: 536410 - DNA, 502 bp, Homo sapiens
  misc_feature: HIJSMM301A3LMN.51.83.H06.1.454.light.4.raw
cgatcgtatacacgaccggtgctcgatttagatcacgtgcgtcgcgggggaggaactgctcagttaggacccagagggaaccatggaagccccacgctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagttttattattgtcagcagcgaaacaactggcctccttggacgttcggccaagggaccgaaggtagggaatacaaacgaactagtggctgcaccatctgttcttcat

SEQ ID NO: 536411 - DNA, 495 bp, Homo sapiens
  misc_feature: HIJSMM301AK5O9.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccggggacccaaggtggatctcaaaagaactgtgggtcgtgccacta

SEQ ID NO: 536412 - DNA, 486 bp, Homo sapiens; identical to SEQ ID NO: 535043
  misc_feature: HIJSMM301AJPK2.46.35.D02.1.454.light.4.raw

SEQ ID NO: 536413 - DNA, 515 bp, Homo sapiens
  misc_feature: HIJSMM301AXFAG.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccaagggaccgaacggtaggaagtacgaaacgaactacgtggcgtgcaccactctgtcttcatcttcccgcctact

SEQ ID NO: 536414 - DNA, 507 bp, Homo sapiens
  misc_feature: HIJSMM301EJQ0O.14.7.A07.1.454.light.4.raw
cgtctagtaccacgaccggtgctcgatttagcacgtgtcgcagggggccctgaggaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatggttttggtcatttcggtgttcggcggagggacccaggtgaccgtcctacgtcagccc

SEQ ID NO: 536415 - DNA, 496 bp, Homo sapiens
  misc_feature: HIJSMM301AIVEO.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaatcaacgaactgtggctgcacc

SEQ ID NO: 536416 - DNA, 506 bp, Homo sapiens
  misc_feature: HIJSMM301DJAN1.43.86.H09.1.454.light.4.raw
tgtgagtagtcacgaccggtgctcgatttagtgctatagacttgggtttgggggatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattactgcatgcaaacttcacactggcctccgttcacttttggccaggggaccaaggtggagatcaaacgaactgtggctgcaccatctgtt

SEQ ID NO: 536417 - DNA, 499 bp, Homo sapiens
  misc_feature: HIJSMM301ADK46.43.33.C11.1.454.light.4.raw
tgtgagtagtcacgaccggtgctcgatttagagtgagctcgttgggtttgggcggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagattttctctcgtcatcactggtctacagtctgacgacggcgcaatgtacttctgtcaacactatgcctctccccctacctaactagttcgacggacggaactaggtacaa

SEQ ID NO: 536418 - DNA, 382 bp, Homo sapiens
  misc_feature: HIJSMM301A2QPG.41.37.D04.1.454.light.4.raw
tctatactatcacgaccggtgctcgatttagtagcatactgttgggtttggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 536419 - DNA, 505 bp, Homo sapiens; identical to SEQ ID NO: 536254
  misc_feature: HIJSMM301BSJVG.7.71.G05.1.454.light.4.raw

SEQ ID NO: 536420 - DNA, 481 bp, Homo sapiens
  misc_feature: HIJSMM301BGV8Q.49.63.F08.1.454.light.4.raw
agtcgagagacacgaccggtgctcgatttagcgatcgtataagggggaggtcagtctcagtcaggacacagcatggacatgagggtccccgcctcagctcctggggcgtcctgctactctggctccgaggtgccagatgtgacatccagatgacccagtctccatcctccctgtctgcatctgtaggagacagagtcaccatcacttgccgggcaagtcagagcattagcggctatttaaattggtatctgcacagtccagggaaagcccctaaggtcctgatttatgctgcatccagtttgcaaagtggggtcccatcaaggttcattggcagtggatttgggacagattttcactctcaccatcaccagtctgcgacctgaggattttggaacatactactgtcaacacagttacagtataccgtacagttttggccaggggaccaagctggagatcacacgaactgtggctgcaccat

SEQ ID NO: 536421 - DNA, 488 bp, Homo sapiens
  misc_feature: HIJSMM301AIZE4.19.71.G05.1.454.light.4.raw
tactctcgtgcacgaccggtgctcgatttagtgtcgtcgcaagagagaggggggaggtacaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttatacagttccaacaatgaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgccgaagggaccgaaggtggatatcagacgaa

SEQ ID NO: 536422 - DNA, 471 bp, Homo sapiens
  misc_feature: HIJSMM301AG9FA.5.28.C06.1.454.light.4.raw
atcagacacgcacgaccggtgctcgatttagagctcacgtattgggtttggggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccaaggtggagatcgaacgaactgtgg

SEQ ID NO: 536423 - DNA, 441 bp, Homo sapiens; identical to SEQ ID NO: 535074
  misc_feature: HIJSMM301CML2T.11.3.A03.1.454.light.4.raw

SEQ ID NO: 536424 - DNA, 447 bp, Homo sapiens; identical to SEQ ID NO: 535020
  misc_feature: HIJSMM301AP3L2.18.9.A09.1.454.light.4.raw

SEQ ID NO: 536425 - DNA, 494 bp, Homo sapiens; identical to SEQ ID NO: 534994
  misc_feature: HIJSMM301CTF0F.27.78.H01.1.454.light.4.raw

SEQ ID NO: 536426 - DNA, 505 bp, Homo sapiens; identical to SEQ ID NO: 536117
  misc_feature: HIJSMM301DXOBH.8.71.G05.1.454.light.4.raw

SEQ ID NO: 536427 - DNA, 484 bp, Homo sapiens
  misc_feature: HIJSMM301DWFF8.10.53.E09.1.454.light.4.raw
catagtagtgcacgaccggtgctcgatttagagagagtgtgttgggtttggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaaacgaa

SEQ ID NO: 536428 - DNA, 351 bp, Homo sapiens
  misc_feature: HIJSMM301CPKCT.4.67.G01.1.454.light.4.raw
agcactgtagcacgaccggtgctcgatttagagtatacatattggttactatgactttgtctcgtggtaccaacaacacccaggcaaagccccaaactcataatttatggtgtcactaagcggccctcaggggtccctgatcgcttctctggctccaagtctggcaacatggcctccctgaccatctctgggctccaggctgaggatgaggctgattactactgctgctcctttgcaggcgcctctgtctcaggcagctatgtcttcggaactgggaccgaagtgaccgtcctgggtcagcccaaggccaaccccactgtcactctgttcccgccctcctcctacagtgct

SEQ ID NO: 536429 - DNA, 444 bp, Homo sapiens; identical to SEQ ID NO: 535192
  misc_feature: HIJSMM301CS2OW.5.9.A09.1.454.light.4.raw

SEQ ID NO: 536430 - DNA, 483 bp, Homo sapiens
  misc_feature: HIJSMM301D4A2Y.41.33.C11.1.454.light.4.raw
tctatactatcacgaccggtgctcgatttagagtgagctcgttgggtttggggaggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggattatgcagtttactactgtctgcagtataaagactggcctagggtcactttcggcctgggaccaaagtggattcaacgaactgtggctgcacc

SEQ ID NO: 536431 - DNA, 500 bp, Homo sapiens
  misc_feature: HIJSMM301EPP7I.11.67.G01.1.454.light.4.raw
cgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcactcttcg

SEQ ID NO: 536432 - DNA, 377 bp, Homo sapiens; identical to SEQ ID NO: 536071
  misc_feature: HIJSMM301A4FUR.40.9.A09.1.454.light.4.raw

SEQ ID NO: 536433 - DNA, 445 bp, Homo sapiens
  misc_feature: HIJSMM301BTAJ4.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttggggtgtttgggtgttcggcggagggaccaagctgaccgtcctaagtcagcccaaggctgccccctcggtcactctgttcccgccctcctccgtgtctgat

SEQ ID NO: 536434 - DNA, 383 bp, Homo sapiens; identical to SEQ ID NO: 447524
  misc_feature: HIJSMM301DLRT4.41.26.C04.1.454.light.4.raw

SEQ ID NO: 536435 - DNA, 503 bp, Homo sapiens
  misc_feature: HIJSMM301EFJF2.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaaactgaccgtcctaggtcagcccaa

SEQ ID NO: 536436 - DNA, 511 bp, Homo sapiens
  misc_feature: HIJSMM301DDMOD.15.34.D01.1.454.light.4.raw
tctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggctggcatttgggtgttcggcggagggaccaaactgaccgtcctaggtcagcccaaggctgccccctggtcactctcg

SEQ ID NO: 536437 - DNA, 505 bp, Homo sapiens
  misc_feature: HIJSMM301AZO15.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaactacacacggccgctcactttcggcggagggaccaaggtggagatcaaacgaactgtggctgcaccatctgtt

SEQ ID NO: 536438 - DNA, 517 bp, Homo sapiens
  misc_feature: HIJSMM301BRMIY.10.26.C04.1.454.light.4.raw
catagtagtgcacgaccggtgctcgatttagtctagcgactttgggtttggggtgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcaggggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgccatctgacactactatg

SEQ ID NO: 536439 - DNA, 516 bp, Homo sapiens
  misc_feature: HIJSMM301EJO08.14.66.F11.1.454.light.4.raw
cgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaaacatccggccctcagggatcccagaccgattctctggctccaactcaggaaacacagcttccttgaccatcactggggctcaggcggaagatgaggctgactattactgtaattcccgggacagcagtgctaaccccaattatgtcttcggaactgggaccaaggtcaccgtcctaggtcagcccaaggccaaccca

SEQ ID NO: 536440 - DNA, 510 bp, Homo sapiens
  misc_feature: HIJSMM301DJCJS.14.7.A07.1.454.light.4.raw
cgtctagtaccacgaccggtgctcgatttagcacgtgtcgcagggggccctgaggaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatggttttggcatttcggtgttcggcggagggacccaggtgaccgtcctacgtcagcccaagg

SEQ ID NO: 536441 - DNA, 453 bp, Homo sapiens
  misc_feature: HIJSMM301DRN0A.19.86.H09.1.454.light.4.raw
tactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccacgagagta

SEQ ID NO: 536442 - DNA, 512 bp, Homo sapiens
  misc_feature: HIJSMM301CDC7E.15.86.H09.1.454.light.4.raw
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttccccacctcctcgctacgtaga

SEQ ID NO: 536443 - DNA, 447 bp, Homo sapiens; identical to SEQ ID NO: 535201
  misc_feature: HIJSMM301BI6BN.18.9.A09.1.454.light.4.raw

SEQ ID NO: 536444 - DNA, 494 bp, Homo sapiens
  misc_feature: HIJSMM301D4JR4.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggccaggggacccaggtggagatcagacgaactgtggctgcaccatctgtcttcatcttcccg

SEQ ID NO: 536445 - DNA, 509 bp, Homo sapiens; identical to SEQ ID NO: 536047
  misc_feature: HIJSMM301BHE04.17.33.C11.1.454.light.4.raw

SEQ ID NO: 536446 - DNA, 503 bp, Homo sapiens
  misc_feature: HIJSMM301BEX7Q.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttccgccat

SEQ ID NO: 536447 - DNA, 493 bp, Homo sapiens; identical to SEQ ID NO: 535047
  misc_feature: HIJSMM301DPRK8.16.53.E09.1.454.light.4.raw

SEQ ID NO: 536448 - DNA, 504 bp, Homo sapiens; identical to SEQ ID NO: 535561
  misc_feature: HIJSMM301B3VMZ.4.57.F02.1.454.light.4.raw

SEQ ID NO: 536449 - DNA, 454 bp, Homo sapiens
  misc_feature: HIJSMM301CHE8P.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccaccctcctccatactcgta

SEQ ID NO: 536450 - DNA, 503 bp, Homo sapiens
  misc_feature: HIJSMM301BQSQH.48.78.H01.1.454.light.4.raw
agtatacatacacgaccggtgctcgatttagtgtgagtagtttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 536451 - DNA, 509 bp, Homo sapiens
  misc_feature: HIJSMM301BTKZM.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccaagggaccgaaggtggaaatacaaaacgaactagtggctgcaccatctgtcttctatcttccccg

SEQ ID NO: 536452 - DNA, 484 bp, Homo sapiens; identical to SEQ ID NO: 535240
  misc_feature: HIJSMM301EMEJ3.47.60.F05.1.454.light.4.raw

SEQ ID NO: 536453 - DNA, 511 bp, Homo sapiens
  misc_feature: HIJSMM301BE7GE.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgtcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctcgtt

SEQ ID NO: 536454 - DNA, 479 bp, Homo sapiens; identical to SEQ ID NO: 535586
  misc_feature: HIJSMM301CAS0J.13.34.D01.1.454.light.4.raw

SEQ ID NO: 536455 - DNA, 481 bp, Homo sapiens
  misc_feature: HIJSMM301B7EM6.43.64.F09.1.454.light.4.raw
tgtgagtagtcacgaccggtgctcgatttagcgcgtatacaagggggagtcagtctcagtcaggacacagcatggacatgagggtccccgctcagctcctggggctcctgctactctggctccgaggtggcagatgtgacatccagatgacccagtctccatcctccctgtctgcatctgtgggggacagagtcaccatcacttgtcgggcaagtcagtccgttaggcattatttaaattggtatcggcagagaccagggatggcccctcagctcatgatctacgctgcttccactctgcaaattggggtcccatcaacgttcagcggcagtgggtctgggacatatttcactctcaccatcaccagtctggaacctgaagattttgcaacttacttctgccaacagacttacagtctccctctcactttcggcggagggaccacagtggagatcaaaggaactgtggctgcaccatctgt

SEQ ID NO: 536456 - DNA, 490 bp, Homo sapiens
  misc_feature: HIJSMM301DDHB7.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccaaggcggaggatcagacgaactgtggctgcaccatctgtcttcta

SEQ ID NO: 536457 - DNA, 421 bp, Homo sapiens
  misc_feature: HIJSMM301CLYWZ.9.34.D01.1.454.light.4.raw
tgatacgtctcacgaccggtgctcgatttagatcgtctgtgttgggtttggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccaccctcctcagacgtatca

SEQ ID NO: 536458 - DNA, 441 bp, Homo sapiens; identical to SEQ ID NO: 534971
  misc_feature: HIJSMM301EITAK.11.3.A03.1.454.light.4.raw

SEQ ID NO: 536459 - DNA, 452 bp, Homo sapiens
  misc_feature: HIJSMM301D56KH.49.72.G06.1.454.light.4.raw
agtcgagagacacgaccggtgctcgatttagctacgactgcaagggaaagggggatcaggactcctcagttcacctcctcacaatgaggctccctgctcagctcctggggctgctaatgctctgggtctctggatccagtgggggtattgtgatgactcagtctccactctccctgcccgtcacccctggagagtcggcctccatctcctgcaggtctagtcagagcctcctatatagggatggatacaactatttggattggttcagcggcagtgtgtccggcacagattttacactaaaaatcagcagagtggaggctgacgatattggggtttattactgcatgcaagcaatacaccgcctcactttcggcggagggaccacactggagatcaaacgaactgtggctgcaccatctgtcttcatcttcccgccatctgatctctcgact

SEQ ID NO: 536460 - DNA, 502 bp, Homo sapiens
  misc_feature: HIJSMM301CSBZY.53.49.E05.1.454.light.4.raw
cgcgtatacacacgaccggtgctcgatttagagcgactagcaacacacaaaggggctgggcctaaggaagcagcactggtggtgcctcagccatggcctggaccgttctcctcctcggcctcctctctcactgcacagactctgtgacctcctatgtgctgactcaggcaccctcgctgtctgtggccccaggacagacggccaggattgcttgtgggggaacaacgttggaagtaacagtgtgcattggtaccagcagaagccacgccaggcccctgtcctggtcttctttgatcatggagaccggccctcagggatccctgagcgattctctggctccaagtctgggaacacggccactttgaccatcatcagggtcgaagccggggatgaggccgactactactgtcagctgtgggacagtagtattcatcagggggcattcggcggagggaccaagctgaccgtcctgggtcagcccaaggctgccccctcggtcact

SEQ ID NO: 536461 - DNA, 493 bp, Homo sapiens
  misc_feature: HIJSMM301CZ1DF.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaagtggatttctagacgaactgtggctgcaccatctgtcttcta

SEQ ID NO: 536462 - DNA, 497 bp, Homo sapiens
  misc_feature: HIJSMM301A6WLW.41.20.B09.1.454.light.4.raw
tctatactatcacgaccggtgctcgatttagtgtagtgtgaagggggagtcagacccagtcaggacacagcatggacatgagggtccccgctcagctcctggggctcctgctgctctggctcccaggtgccaaatgtgagatccagatgacccagtctccttccaccctgtctgcatctgttggagacacagtcaccatcacttgccgggccagtcagtatattaatgactggttggcctggtatcagcagaaaagagggagggccccaaagctcctgatttacaaggcaggctatttagaaaatggggccccatcaagatttagtggctttggaactgggacggagttcactctcaccatcaccggcctgcagcctgatgactttgcaacttattactgccagcaatatgacgtttacccgctcactttcggcggagggaccaaggtggagatcaaaggaactgtggctgcaccatctgtcttcatcttcccgcca

SEQ ID NO: 536463 - DNA, 494 bp, Homo sapiens
  misc_feature: HIJSMM301AOR8G.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcatt

SEQ ID NO: 536464 - DNA, 506 bp, Homo sapiens
  misc_feature: HIJSMM301BVPLI.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccgggatgaggccgactattactgtcaggtgtgggctggtgataatgatcatgcggggtgttcggcggagggaccaagctgaccgtcctaagtcagcccaaggctgccccctcggtcactctcg

SEQ ID NO: 536465 - DNA, 505 bp, Homo sapiens
  misc_feature: HIJSMM301CQPEW.48.25.C03.1.454.light.4.raw
  modified_base (494)..(494): a, c, t, g, unknown or other
agtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttnatcttcccgcc

SEQ ID NO: 536466 - DNA, 453 bp, Homo sapiens; identical to SEQ ID NO: 536441
  misc_feature: HIJSMM301C5JDJ.19.86.H09.1.454.light.4.raw

SEQ ID NO: 536467 - DNA, 492 bp, Homo sapiens; identical to SEQ ID NO: 535864
  misc_feature: HIJSMM301B5J9D.3.71.G05.1.454.light.4.raw

SEQ ID NO: 536468 - DNA, 515 bp, Homo sapiens
  misc_feature: HIJSMM301DQZ5R.41.25.C03.1.454.light.4.raw
tctatactatcacgaccggtgctcgatttagtagtgtagatttgggtttggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtccctttcggtttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttcccg

SEQ ID NO: 536469 - DNA, 504 bp, Homo sapiens
  misc_feature: HIJSMM301EC40C.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgaccgtcctacgtcagcccaaggctgccccctcggtcactctgttccccg

SEQ ID NO: 536470 - DNA, 484 bp, Homo sapiens
  misc_feature: HIJSMM301CCQPS.43.60.F05.1.454.light.4.raw
  modified_base (451)..(451): a, c, t, g, unknown or other
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgtcgtcgcggacgaccggnggtagtagtcagacgactagtgcgtgcgacact

SEQ ID NO: 536471 - DNA, 493 bp, Homo sapiens
  misc_feature: HIJSMM301DBHQ9.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtcact

SEQ ID NO: 536472 - DNA, 444 bp, Homo sapiens; identical to SEQ ID NO: 534993
  misc_feature: HIJSMM301AHGE4.5.9.A09.1.454.light.4.raw

SEQ ID NO: 536473 - DNA, 496 bp, Homo sapiens
  misc_feature: HIJSMM301AHZ2D.16.78.H01.1.454.light.4.raw
tgtactactccacgaccggtgctcgatttagtgtgagtagtttgggtttggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtggggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgt

SEQ ID NO: 536474 - DNA, 495 bp, Homo sapiens
  misc_feature: HIJSMM301A84UX.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaacctgtggctgcaccatctgtctt

SEQ ID NO: 536475 - DNA, 495 bp, Homo sapiens
  misc_feature: HIJSMM301A2UIF.27.78.H01.1.454.light.4.raw
  modified_base (403)..(403): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattacngtcatcagagtactactttacctcaagtgatcaccttcggcccaagggacacgactggagattaaacgaactgtggctgcaccatctgtctt

SEQ ID NO: 536476 - DNA, 508 bp, Homo sapiens
  misc_feature: HIJSMM301C2DF1.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggttcactctgttcccta

SEQ ID NO: 536477 - DNA, 494 bp, Homo sapiens
  misc_feature: HIJSMM301BEL2D.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcatcttcccgc

SEQ ID NO: 536478 - DNA, 306 bp, Homo sapiens
  misc_feature: HIJSMM301EWOUG.49.19.B08.1.454.light.4.raw
agtcgagagacacgaccggtgctcgatttagtgagtcagtaagggcccccagactcctcattcatgacaatagcaagcgagtcccagagattcctgaccgattctctggctccaagtctggcacctcagccaccctggccatcaccggactccagactggggacgaggccgattattactgcggaacatgggattccagcctgagtggtgtcagggtgttcggcggagggaccaagctgaccgtcctaggtcagcccaaggctggcccctcggtcactctgttcccaccctacctctctctcgact

SEQ ID NO: 536479 - DNA, 491 bp, Homo sapiens; identical to SEQ ID NO: 535176
  misc_feature: HIJSMM301CXKAG.13.39.D06.1.454.light.4.raw

SEQ ID NO: 536480 - DNA, 500 bp, Homo sapiens
  misc_feature: HIJSMM301C4RME.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgtttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgttcccaccct

SEQ ID NO: 536481 - DNA, 490 bp, Homo sapiens
  misc_feature: HIJSMM301ASFDZ.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaactgt

SEQ ID NO: 536482 - DNA, 415 bp, Homo sapiens
  misc_feature: HIJSMM301EFJ3V.16.46.E02.1.454.light.4.raw
tgtactactccacgaccggtgctcgatttagactcatctacagggaaaggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccgccctcctcgagtagtaca

SEQ ID NO: 536483 - DNA, 491 bp, Homo sapiens; identical to SEQ ID NO: 535294
  misc_feature: HIJSMM301AWVXY.16.68.G02.1.454.light.4.raw

SEQ ID NO: 536484 - DNA, 444 bp, Homo sapiens
  misc_feature: HIJSMM301B1CPD.8.11.A11.1.454.light.4.raw
ctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaggaaaagcccccggactcctcatttttgttaacaacgatcgcccctcaggggtccctgaccgcttctctggctccaggtctggcgcctctgcctccctggccatcgctgggctccaccttgacgatgagggtttttattactgccagtcgtacgacgacagtctgactgccccggtgttcggcggcgggaccaaggtgaccgtcctgagtcagcccaaggctgcccccacggtcactctgttcccaccctcctcgacacgcgag

SEQ ID NO: 536485 - DNA, 483 bp, Homo sapiens; identical to SEQ ID NO: 535413
  misc_feature: HIJSMM301A7HLJ.26.78.H01.1.454.light.4.raw

SEQ ID NO: 536486 - DNA, 495 bp, Homo sapiens
  misc_feature: HIJSMM301B0KF7.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctagggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 536487 - DNA, 495 bp, Homo sapiens
  misc_feature: HIJSMM301DADLS.52.86.H09.1.454.light.4.raw
cgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgt

SEQ ID NO: 536488 - DNA, 473 bp, Homo sapiens
  misc_feature: HIJSMM301B6MHU.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtcaaaagtataacagtgcccccttcaccttcggccaagggacacgactggagattagacg

SEQ ID NO: 536489 - DNA, 501 bp, Homo sapiens; identical to SEQ ID NO: 535873
  misc_feature: HIJSMM301AJ8XZ.17.27.C05.1.454.light.4.raw

SEQ ID NO: 536490 - DNA, 480 bp, Homo sapiens; identical to SEQ ID NO: 535291
  misc_feature: HIJSMM301EELUR.22.59.F04.1.454.light.4.raw

SEQ ID NO: 536491 - DNA, 519 bp, Homo sapiens
  misc_feature: HIJSMM301CEH0S.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccaaggaccgaaggtaggaagtacgaacgaactagtggcgtgcaccactctgtcttctactcttcccgtccactctcgat

SEQ ID NO: 536492 - DNA, 484 bp, Homo sapiens; identical to SEQ ID NO: 535441
  misc_feature: HIJSMM301EN2KS.26.60.F05.1.454.light.4.raw

SEQ ID NO: 536493 - DNA, 492 bp, Homo sapiens
  misc_feature: HIJSMM301DS6SZ.51.28.C06.1.454.light.4.raw
cgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcggggaccgaagctgaccgtccgtcggtcagccaacggctcgccccctcggt

SEQ ID NO: 536494 - DNA, 493 bp, Homo sapiens
  misc_feature: HIJSMM301AO4UP.27.78.H01.1.454.light.4.raw
  modified_base (478)..(478): a, c, t, g, unknown or other
agcgtcgtctcacgaccggtgctcgatttagtgtgagtagtttgggtttggggatcttaaaagaggttctttctctaggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttactcaagtgatcactcgcaagganacactgagataaacg

SEQ ID NO: 536495 - DNA, 503 bp, Homo sapiens
  misc_feature: HIJSMM301BAPAU.43.38.D05.1.454.light.4.raw
tgtgagtagtcacgaccggtgctcgatttagtatctgatagttgggtttgggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaagggaccagggtggaaagtcaaacgaactgtggctgcaccatctgtcttcatcttccccg

SEQ ID NO: 536496 - DNA, 515 bp, Homo sapiens
  misc_feature: HIJSMM301A2IKA.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccaaggaccgaacggtaggaagtacgaacgaaactagtggcgtgcaccactctgtcttctactcttcccgtccact

SEQ ID NO: 536497 - DNA, 489 bp, Homo sapiens; identical to SEQ ID NO: 535139
  misc_feature: HIJSMM301A1H9F.14.55.E11.1.454.light.4.raw

SEQ ID NO: 536498 - DNA, 497 bp, Homo sapiens; identical to SEQ ID NO: 536371
  misc_feature: HIJSMM301BVJKQ.16.78.H01.1.454.light.4.raw

SEQ ID NO: 536499 - DNA, 504 bp, Homo sapiens
  misc_feature: HIJSMM301DMQV1.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtcttcaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaacgaactgtggctgcaccatctgtctt

SEQ ID NO: 536500 - DNA, 501 bp, Homo sapiens
  misc_feature: HIJSMM301AKRNL.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgttcccaccct

SEQ ID NO: 536501 - DNA, 473 bp, Homo sapiens
  misc_feature: HIJSMM301EPWLE.18.59.F04.1.454.light.4.raw
tacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactacatgatttattgatgtcagtaatcggccctcaggggtttcgttaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgccctcctcatactcgta

SEQ ID NO: 536502 - DNA, 444 bp, Homo sapiens; identical to SEQ ID NO: 535192
  misc_feature: HIJSMM301DWJ5X.5.9.A09.1.454.light.4.raw

SEQ ID NO: 536503 - DNA, 495 bp, Homo sapiens
  misc_feature: HIJSMM301CN3QF.16.53.E09.1.454.light.4.raw
tgtactactccacgaccggtgctcgatttagagagagtgtgttgggtttggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccgagggaccaagctggagatcaaacgaacgtgtggcg

SEQ ID NO: 536504 - DNA, 520 bp, Homo sapiens
  misc_feature: HIJSMM301BWRZW.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcccgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctcacgcg

SEQ ID NO: 536505 - DNA, 490 bp, Homo sapiens; identical to SEQ ID NO: 535488
  misc_feature: HIJSMM301A3574.41.72.G06.1.454.light.4.raw

SEQ ID NO: 536506 - DNA, 469 bp, Homo sapiens
  misc_feature: HIJSMM301EVW6Q.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcgggggacgaacgtggcatcaacgaa

SEQ ID NO: 536507 - DNA, 482 bp, Homo sapiens
  misc_feature: HIJSMM301C73MJ.49.44.D11.1.454.light.4.raw
agtcgagagacacgaccggtgctcgatttagcgcagtacgaagggtttgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcgcggagggaccagggtggagatcaaacgaa

SEQ ID NO: 536508 - DNA, 511 bp, Homo sapiens
  misc_feature: HIJSMM301BP3ZH.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgctagtttattactgtcaacatcgtaccgagtggcctccgggggccactttcggccctcgggaccaaggtggagatacaaacgaactgtggctgcaccatctgtcttcta

SEQ ID NO: 536509 - DNA, 510 bp, Homo sapiens
  misc_feature: HIJSMM301AFCJP.8.38.D05.1.454.light.4.raw
ctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattagagatcaacgaactagtggctgcaccatctgtcttctatcttcccg

SEQ ID NO: 536510 - DNA, 483 bp, Homo sapiens
  misc_feature: HIJSMM301CNZYH.52.53.E09.1.454.light.4.raw
  modified_base (435)..(435): a, c, t, g, unknown or other
cgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcagggggacggtatccctgatcgcttctcaggctccggctctgggactgagcgctacctcaccatctccagcctccagtctgaggacgagggtgactattactgtcagacgtgggacactggcatttgggngttcggcggagggaccaagttgaccgtcctaggtcagcccaaggctcg

SEQ ID NO: 536511 - DNA, 493 bp, Homo sapiens; identical to SEQ ID NO: 535084
  misc_feature: HIJSMM301EK0LC.47.64.F09.1.454.light.4.raw

SEQ ID NO: 536512 - DNA, 495 bp, Homo sapiens
  misc_feature: HIJSMM301EL2MR.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccgggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccaaggtggagatcaaacgaactgtggctgcaccatctgtctt

SEQ ID NO: 536513 - DNA, 479 bp, Homo sapiens
  misc_feature: HIJSMM301BZ0BP.40.8.A08.1.454.light.4.raw
tctagcgactcacgaccggtgctcgatttagcatactctacagggggagctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagactgttttatacagctccaacaatgagaactacgttgcttggtaccagcagaaaccaggacagcctcctaagttgctcatttactgggcatctacccgggcatccggggtccctgaccgattcagtggcagcgggtctgggacagatttcactctcaccatcaacaacctgcaggctgaagatgtggcagtttattactgtcaacaatattatactactccgctcactttcggcggaggcaccaaggtggagatcagacgaa

SEQ ID NO: 536514 - DNA, 502 bp, Homo sapiens
  misc_feature: HIJSMM301CMSF4.48.30.C08.1.454.light.4.raw
agtatacatacacgaccggtgctcgatttagtctgacgtcaaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtacttttagttacgtcggaccttcggccaagggacacgactggagattaaacgaactgtggctgcaccatctgtcttcatcttcccgccta

SEQ ID NO: 536515 - DNA, 486 bp, Homo sapiens; identical to SEQ ID NO: 535523
  misc_feature: HIJSMM301DWLKJ.22.73.G07.1.454.light.4.raw

SEQ ID NO: 536516 - DNA, 494 bp, Homo sapiens; identical to SEQ ID NO: 534992
  misc_feature: HIJSMM301CVNFP.9.1.A01.1.454.light.4.raw

SEQ ID NO: 536517 - DNA, 535 bp, Homo sapiens
  misc_feature: HIJSMM301AYFUV.4.71.G05.1.454.light.4.raw
agcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctggagtggtcggacgggacggaacctaaagtcgtacccgtacgtacgtagacccgaaccggaacggtctccccgtcccccgttcggtccacttcgtttcccc

SEQ ID NO: 536518 - DNA, 509 bp, Homo sapiens
  misc_feature: HIJSMM301DZA9W.16.46.E02.1.454.light.4.raw
tgtactactccacgaccggtgctcgatttagactcatctacagggaaaggggggagtctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgcttcggaactgggaccaaggtcaccgtcctaggtcagccaacggccaacccactgtcactctcg

SEQ ID NO: 536519 - DNA, 485 bp, Homo sapiens
  misc_feature: HIJSMM301BTF4N.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctcccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccaccctcctctacgtgagct

SEQ ID NO: 536520 - DNA, 502 bp, Homo sapiens
  misc_feature: HIJSMM301C5HDR.43.38.D05.1.454.light.4.raw
tgtgagtagtcacgaccggtgctcgatttagtatctgatagttgggtttgggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaaggaccgagggtggaaatcaaacgaactgtggctgcaccatctgtcttcatcttccccg

SEQ ID NO: 536521 - DNA, 508 bp, Homo sapiens
  misc_feature: HIJSMM301DHXMJ.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttccc

SEQ ID NO: 536522 - DNA, 517 bp, Homo sapiens
  misc_feature: HIJSMM301CSQWU.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtcaagtgtgggacaccaacacttgtgtcttcgggactgggaccgaggtcaccgtcctaagtcagcccagggccaaccccactgtcactctgttcccacctcctcgacacg

SEQ ID NO: 536523 - DNA, 447 bp, Homo sapiens; identical to SEQ ID NO: 535201
  misc_feature: HIJSMM301AFGXD.18.9.A09.1.454.light.4.raw

SEQ ID NO: 536524 - DNA, 480 bp, Homo sapiens; identical to SEQ ID NO: 535291
  misc_feature: HIJSMM301BTLLQ.22.59.F04.1.454.light.4.raw

SEQ ID NO: 536525 - DNA, 494 bp, Homo sapiens; identical to SEQ ID NO: 534994
  misc_feature: HIJSMM301BVWVI.27.78.H01.1.454.light.4.raw

SEQ ID NO: 536526 - DNA, 483 bp, Homo sapiens
  misc_feature: HIJSMM301EO4GA.10.3.A03.1.454.light.4.raw
catagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggcctggtatcagaagaaaccagggaaagccccgaaactcctgatccatactgcctccactttggcaagtggggtcccatcaaggttcagcggcagtggagctgggacagagttcactctcagtatcagcagcctgcagcctgatgattttgcaacctattattgtcaacaatatgacacttatccattctctttcggccctgggaccaaagtggattccaaacgaactgtggctgcaccatctgtcttcatcttcccgccatctgacactacta

SEQ ID NO: 536527 - DNA, 485 bp, Homo sapiens
  misc_feature: HIJSMM301EY4C5.3.77.G11.1.454.light.4.raw
agacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcactggtctcccaggcaggttcagtggcagtggatctgggacagaattcacgctcaccatcatcaggctgcggtctgacgacttcgcagtctatttctgtcaacagtacgatggccggcctccgtggacattcggccaaggtccaaggtggacatcagacgaactgtggctgcacc

SEQ ID NO: 536528 - DNA, 453 bp, Homo sapiens
  misc_feature: HIJSMM301D3LVX.19.86.H09.1.454.light.4.raw
tactctcgtgcacgaccggtgctcgatttagtgctatagacttggggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgcccctcggtcactctgttcccaccctcctccacgagagta

SEQ ID NO: 536529 - DNA, 459 bp, Homo sapiens
  misc_feature: HIJSMM301BPX1I.11.86.H09.1.454.light.4.raw
cgagagataccacgaccggtgctcgatttagtgctatagacttgggtttgggggccgttcctgggcccagtctgtgctgactcagccaccctcagcgtctgggacccccggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccgccctcctcgtatctctcg

SEQ ID NO: 536530 - DNA, 506 bp, Homo sapiens
  misc_feature: HIJSMM301BNR5U.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaaggaccgggtggaaataaacgaactgtggctgcaccatctgtcttcat

SEQ ID NO: 536531 - DNA, 485 bp, Homo sapiens
  misc_feature: HIJSMM301AULL9.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgccaagggaccaaggtggatatcagacgaa

SEQ ID NO: 536532 - DNA, 501 bp, Homo sapiens
  misc_feature: HIJSMM301DXALM.41.18.B07.1.454.light.4.raw
tctatactatcacgaccggtgctcgatttagtcgctgcgtaaagggggtagggtccaggacggcagaacttctgggtcgtcctcaccatggcctggatccctctacttctcccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgcccctcggtcactctgtt

SEQ ID NO: 536533 - DNA, 488 bp, Homo sapiens
  misc_feature: HIJSMM301ECZYI.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcctacgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaa

SEQ ID NO: 536534 - DNA, 493 bp, Homo sapiens
  misc_feature: HIJSMM301EFQVA.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtcctaggtcagcccaaggctgccccctcggtca

SEQ ID NO: 536535 - DNA, 476 bp, Homo sapiens
  misc_feature: HIJSMM301AG7LG.52.1.A01.1.454.light.4.raw
cgcagtacgacacgaccggtgctcgatttagacgtctcatcaggggcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctggaccatagtggatatcaaacgaactgtggctgcaccatctgtctt

SEQ ID NO: 536536 - DNA, 487 bp, Homo sapiens
  misc_feature: HIJSMM301CKQ9N.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaaggtggagatcaaacgaactgt

SEQ ID NO: 536537 - DNA, 494 bp, Homo sapiens; identical to SEQ ID NO: 535276
  misc_feature: HIJSMM301BB9B9.16.6.A06.1.454.light.4.raw

SEQ ID NO: 536538 - DNA, 485 bp, Homo sapiens; identical to SEQ ID NO: 535606
  misc_feature: HIJSMM301A7Z6W.47.46.E02.1.454.light.4.raw

SEQ ID NO: 536539 - DNA, 446 bp, Homo sapiens
  misc_feature: HIJSMM301AD9RM.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtcccgtgaccgattctctggctccaagtctggcacctcagcctccctggccatcactgggcttcaggctgaggatgaggctgattattactgccactcctatgacagcagcctgagaagtgtggtattcggcggagggaccaagctgaacgtcctaggtcagcccaaggctgccccctccggtcactctgttcccaccctcctcagacgtatca

SEQ ID NO: 536540 - DNA, 476 bp, Homo sapiens
  misc_feature: HIJSMM301ELZ0L.5.15.B04.1.454.light.4.raw
  modified_base (473)..(473): a, c, t, g, unknown or other
atcagacacgcacgaccggtgctcgatttagacagtatatatccgcggggttcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttaattggacgttcggccaagggaccaaggtggaaatcaaacgaaactgtggctgnacc

SEQ ID NO: 536541 - DNA, 489 bp, Homo sapiens; identical to SEQ ID NO: 535139
  misc_feature: HIJSMM301C852X.14.55.E11.1.454.light.4.raw

SEQ ID NO: 536542 - DNA, 504 bp, Homo sapiens
  misc_feature: HIJSMM301C9IVZ.9.12.B01.1.454.light.4.raw
  modified_base (428)..(428): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttcncgggcgttcggccaagggaccaaggtggaaagtcaaaacgaactagtggctgcaccatctgtcttcatcttccccg

SEQ ID NO: 536543 - DNA, 494 bp, Homo sapiens; identical to SEQ ID NO: 534994
  misc_feature: HIJSMM301BRXUW.27.78.H01.1.454.light.4.raw

SEQ ID NO: 536544 - DNA, 493 bp, Homo sapiens
  misc_feature: HIJSMM301CU32M.3.12.B01.1.454.light.4.raw
agacgcactccacgaccggtgctcgatttagtagtgtagattccgcggggtggggaggaactgctcagttaggacccagacggaaccatggaagccccagcgcagcttctcttcctcctgctactctggctcccagatatcactggagaaacagtgctgacgcagtctccagccaccctgtctgtgtctccaggggaaagagccaccctctcctgcagggccagtcagagtgttagtagcaacttagcctggtaccagcatattcttggccaggctcccaggctcctcatctatggtgcatccacccgggccactggtatcccagccaggttcagtggcagtgggtctcggacagagttcactctcaccatcagcagcctggagtctgaagactctgcagtttatactgtcagcagtataattactggccgtggacgttcggccaagggaccaaggtggaaatcaaacgaactgtggctgcaccatctgtctt

SEQ ID NO: 536545 - DNA, 501 bp, Homo sapiens
  misc_feature: HIJSMM301BC63G.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaactcgacgtcctaggtcagcccaaggctgccccctc

SEQ ID NO: 536546 - DNA, 494 bp, Homo sapiens
  misc_feature: HIJSMM301CHAK5.51.45.E01.1.454.light.4.raw
cgatcgtatacacgaccggtgctcgatttagtgagtcagtaagggaaaggggtgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggtattttggggtttattactgcgtgcaaagtctgcaactatcaccttcggccaagggacacgactggagattaaacgaactgtggctgcacat

SEQ ID NO: 536547 - DNA, 488 bp, Homo sapiens
  misc_feature: HIJSMM301BLAGI.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctaccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaaatcaaacgaactgtggctgcaccat

SEQ ID NO: 536548 - DNA, 476 bp, Homo sapiens
  misc_feature: HIJSMM301A92VC.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgtaaggggaaagtaatgaagttaacactgtggatcaccttcggccaagggacacgactggagattaaacgaactgtggctgcaccatctgtcttcatcttcccgccatctgaagtatagtct

SEQ ID NO: 536549 - DNA, 491 bp, Homo sapiens
  misc_feature: HIJSMM301AWMED.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtcactctgttcccaccctcctctacgtgagct

SEQ ID NO: 536550 - DNA, 446 bp, Homo sapiens
  misc_feature: HIJSMM301C7EPJ.47.85.H08.1.454.light.4.raw
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactacataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccaccctcctctacgtgagct

SEQ ID NO: 536551 - DNA, 455 bp, Homo sapiens; identical to SEQ ID NO: 535447
  misc_feature: HIJSMM301B49G4.19.71.G05.1.454.light.4.raw

SEQ ID NO: 536552 - DNA, 493 bp, Homo sapiens
  misc_feature: HIJSMM301B14FJ.27.78.H01.1.454.light.4.raw
agcgtcgtctcacgaccggtgctcgatttagtgtgagtagtttgggtttgggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 536553 - DNA, 486 bp, Homo sapiens
  misc_feature: HIJSMM301BRN8U.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaaggaccaaggtggaactcaaacgaa

SEQ ID NO: 536554 - DNA, 488 bp, Homo sapiens
  misc_feature: HIJSMM301ARNKA.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactgtggctgcacca

SEQ ID NO: 536555 - DNA, 486 bp, Homo sapiens
  misc_feature: HIJSMM301EJ0Q8.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtggctgcaccatct

SEQ ID NO: 536556 - DNA, 476 bp, Homo sapiens
  misc_feature: HIJSMM301A2O2T.4.34.D01.1.454.light.4.raw
agcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagattttgcggtttattactgtcagcagtatgataactggctgtacacttttggccaggggaccaagctggagatcaggcgaactgtgg

SEQ ID NO: 536557 - DNA, 377 bp, Homo sapiens; identical to SEQ ID NO: 536071
  misc_feature: HIJSMM301CNXBU.40.9.A09.1.454.light.4.raw

SEQ ID NO: 536558 - DNA, 499 bp, Homo sapiens
  misc_feature: HIJSMM301D6652.48.71.G05.1.454.light.4.raw
agtatacatacacgaccggtgctcgatttagtgtcgtcgcaagagagaggggagagctgctcagttaggacccagagggaaccatggaaacccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaacctggccagcctcccaggctcctcatctatggtgcgtccaccagggccactggcatcccagacaggttcagtggcagtgggtctgggacagacttcactctcaccatcaccagactggagcctgatgattttgcagtgttttctgtcagcagtatggaagttcacctcggacattcggccaggggaccaaggtggaaatcaaacgaactgtggctgcaccatctgtcttcatcttccg

SEQ ID NO: 536559 - DNA, 501 bp, Homo sapiens
  misc_feature: HIJSMM301B1OS0.10.65.F10.1.454.light.4.raw
catagtagtgcacgaccggtgctcgatttagctacgctctaaggggcaggagtcagtctcagtcaggacacagcatggacatgagggtccccgctcagctcctggggctcctgctactctggctccgaggtgccagatgtgacatcccagatgacccagtcgtccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagttttcccggaacccgttactttcggcggagggaccaaggtggagatcaaacgaactgtggctgcaccatctgtcttcaatctccccg

SEQ ID NO: 536560 - DNA, 486 bp, Homo sapiens; identical to SEQ ID NO: 535290
  misc_feature: HIJSMM301C1VSF.3.12.B01.1.454.light.4.raw

SEQ ID NO: 536561 - DNA, 444 bp, Homo sapiens; identical to SEQ ID NO: 535594
  misc_feature: HIJSMM301A6VBO.9.9.A09.1.454.light.4.raw

SEQ ID NO: 536562 - DNA, 489 bp, Homo sapiens; identical to SEQ ID NO: 535139
  misc_feature: HIJSMM301AUB26.14.55.E11.1.454.light.4.raw

SEQ ID NO: 536563 - DNA, 485 bp, Homo sapiens
  misc_feature: HIJSMM301AOWVS.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggaggatcaaacgaaactgtcggctgcaccat

SEQ ID NO: 536564 - DNA, 444 bp, Homo sapiens; identical to SEQ ID NO: 534993
  misc_feature: HIJSMM301EO17Y.5.9.A09.1.454.light.4.raw

SEQ ID NO: 536565 - DNA, 492 bp, Homo sapiens
  misc_feature: HIJSMM301CYOX5.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctaatctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgtcttcat

SEQ ID NO: 536566 - DNA, 486 bp, Homo sapiens; identical to SEQ ID NO: 535043
  misc_feature: HIJSMM301BKTN5.46.35.D02.1.454.light.4.raw

SEQ ID NO: 536567 - DNA, 494 bp, Homo sapiens
  misc_feature: HIJSMM301DK2LT.43.77.G11.1.454.light.4.raw
tgtgagtagtcacgaccggtgctcgatttagctagtcactcaaggggaaaggggcttcagctgtgggcacaagaggcagcactcaggacagtctccagcatggcctggtcttctctcctcctcactctcctcgctcactgcacagggtcctgggcccagtctgtgctgacgcagccgccctcagtgtctggggccccagggcagagggtcaccatcccctgtactgggagcagtttcaacatcggggcaggtttggatgttaactggtaccagcaacttccaggatcagcccccaaactcctcatctatggtaccaccaatcggccctcaggagtccctgaccgattctctggctccaagtctggcatctcagccttcctggccatcactggactccaggtcgaggatgaggctgattattactgccaggcctgggacatcagcctgagtggccattatgtcttcggaaccgcgaccaaggtcaccgtctaggt

SEQ ID NO: 536568 - DNA, 486 bp, Homo sapiens; identical to SEQ ID NO: 535043
  misc_feature: HIJSMM301AESSL.46.35.D02.1.454.light.4.raw

SEQ ID NO: 536569 - DNA, 484 bp, Homo sapiens; identical to SEQ ID NO: 535211
  misc_feature: HIJSMM301B8QJH.47.46.E02.1.454.light.4.raw

SEQ ID NO: 536570 - DNA, 484 bp, Homo sapiens
  misc_feature: HIJSMM301A3P2T.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgcagtctattactgtcagcagtatggtcacgtcccaagaacttttggccagggaccaagctggagatcaaacgaactgtggctgcaccat

SEQ ID NO: 536571 - DNA, 505 bp, Homo sapiens
  misc_feature: HIJSMM301EL3J7.48.62.F07.1.454.light.4.raw
agtatacatacacgaccggtgctcgatttagtagtcgcataaagggaaaggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccgaacgtaggaatacaaacgaactgtggctgcaccatctgt

SEQ ID NO: 536572 - DNA, 487 bp, Homo sapiens
  misc_feature: HIJSMM301BNQMG.4.4.A04.1.454.light.4.raw
agcactgtagcacgaccggtgctcgatttagagtagtgatcagggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgtcgggcaagtcagagtattaatagttggttggcctggtatcaccagagaccaggagaggccccaaggctccttatttatgatgcctccactgtgattagtggggtcccaccaacgttcagcggcagtggatctgggacatacttcactctcaccatcagcagcctgcagcctgatgatcttggaacttattactgccaacagtataatagtttttggacgttcggtccaggggaccgaaggtcgaaatgagacgaactgtggctgcaccactctgtcttcta

SEQ ID NO: 536573 - DNA, 444 bp, Homo sapiens; identical to SEQ ID NO: 535192
  misc_feature: HIJSMM301CQ9PX.5.9.A09.1.454.light.4.raw

SEQ ID NO: 536574 - DNA, 486 bp, Homo sapiens; identical to SEQ ID NO: 535043
  misc_feature: HIJSMM301C9Q71.46.35.D02.1.454.light.4.raw

SEQ ID NO: 536575 - DNA, 447 bp, Homo sapiens; identical to SEQ ID NO: 535882
  misc_feature: HIJSMM301BGABR.18.9.A09.1.454.light.4.raw
  modified_base (429)..(429): a, c, t, g, unknown or other

SEQ ID NO: 536576 - DNA, 485 bp, Homo sapiens
  misc_feature: HIJSMM301CSGOY.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatcaaacgaactgtggctgcaccat

SEQ ID NO: 536577 - DNA, 483 bp, Homo sapiens; identical to SEQ ID NO: 535413
  misc_feature: HIJSMM301AT6CI.26.78.H01.1.454.light.4.raw

SEQ ID NO: 536578 - DNA, 499 bp, Homo sapiens
  misc_feature: HIJSMM301DADMS.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtggctgcacca

SEQ ID NO: 536579 - DNA, 503 bp, Homo sapiens
  misc_feature: HIJSMM301A7DFI.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaaggacacgactggagattaaaacg

SEQ ID NO: 536580 - DNA, 502 bp, Homo sapiens
  misc_feature: HIJSMM301B8MBK.19.71.G05.1.454.light.4.raw
tactctcgtgcacgaccggtgctcgatttagtgtcgtcgcaagagagaggggggggtacgaacaggcaggcaggggcgagcaagatggtgttgcagacccacggtcttcatttcttctgttgctctggatctctggtgcccacggggacatcgtgatgacccagtctccagactccctggctgtgtctctgggcgagcgggccaccatcaactgcaagtccagccacaatcttttatacagttccaacaatgaaactacttagcttggtaccagcagagaccaggacagcctcctaggctgctcatttactgggcatctacccggggaatccggggtcccctgaccgattcagtggcagcgggtctgggacagattttcactctcaccatcagcagcctgcaggctgaagatgtggcagtttattattgtcaacaatattattatacttcgtggacgttcggcaacggaccgaaggtggatatcagacgaactgtggctgca

SEQ ID NO: 536581 - DNA, 474 bp, Homo sapiens
  misc_feature: HIJSMM301EI438.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggcctggactgaagtgcatatgaagagaactgtggctgca

SEQ ID NO: 536582 - DNA, 485 bp, Homo sapiens
  misc_feature: HIJSMM301ERJH5.3.46.E02.1.454.light.4.raw
agacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccaacagaaacctggccaggctcccaggctcctcattcatggtgcatctaacagggccgatggcattccagccaggttcagtggcagtggatatgggacagacttcactctcaccatcagcaatctgcagtctgaagattttgcagtttatttctgtcagcagtttaacacctggcctggaagttttggccaggggaccaagctggagctcaaacgaactgtggctgcaccat

SEQ ID NO: 536583 - DNA, 453 bp, Homo sapiens
  misc_feature: HIJSMM301AZ759.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctcacgagagta

SEQ ID NO: 536584 - DNA, 502 bp, Homo sapiens
  misc_feature: HIJSMM301D8MIF.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaaggtggagttcaaacgaactgtggctgcaccatctgtcttcatcttcccg

SEQ ID NO: 536585 - DNA, 489 bp, Homo sapiens
  misc_feature: HIJSMM301AESLN.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaattcggtggagggaccaaggtggaggtcaaacgaactgtggctgcaccatctgtcttcat

SEQ ID NO: 536586 - DNA, 457 bp, Homo sapiens
  misc_feature: HIJSMM301C5V70.49.85.H08.1.454.light.4.raw
agtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgt

SEQ ID NO: 536587 - DNA, 484 bp, Homo sapiens; identical to SEQ ID NO: 535441
  misc_feature: HIJSMM301BLYQ5.26.60.F05.1.454.light.4.raw

SEQ ID NO: 536588 - DNA, 441 bp, Homo sapiens
  misc_feature: HIJSMM301EKVBJ.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcaatctgttcccaccctcctcgtatctctcg

SEQ ID NO: 536589 - DNA, 453 bp, Homo sapiens
  misc_feature: HIJSMM301AFU8Q.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgcccctccggtcactctgttcccgccctcctccacgagagta

SEQ ID NO: 536590 - DNA, 480 bp, Homo sapiens
  misc_feature: HIJSMM301BDDQV.11.17.B06.1.454.light.4.raw
cgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaaggtggaaatcaaacgaactgtggctgcacca

SEQ ID NO: 536591 - DNA, 500 bp, Homo sapiens
  misc_feature: HIJSMM301CWD5W.51.27.C05.1.454.light.4.raw
cgatcgtatacacgaccggtgctcgatttagacgcgatcgaagggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggcctgtggatgaggctgactattactgtcaggcgtgggacagggaggctgcgattttcgggcggagggaccagtctgaccgtcctaggtcagcccaaggctgccccctcggtcactctcg

SEQ ID NO: 536592 - DNA, 501 bp, Homo sapiens
  misc_feature: HIJSMM301EA7I0.48.67.G01.1.454.light.4.raw
agtatacatacacgaccggtgctcgatttagagtatacatattgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgactgtggctgcaccatctgtcttcatcttccccg

SEQ ID NO: 536593 - DNA, 444 bp, Homo sapiens; identical to SEQ ID NO: 535192
  misc_feature: HIJSMM301AO27J.5.9.A09.1.454.light.4.raw

SEQ ID NO: 536594 - DNA, 507 bp, Homo sapiens
  misc_feature: HIJSMM301AVZ4M.40.26.C04.1.454.light.4.raw
tctagcgactcacgaccggtgctcgatttagtctagcgactttgggtttggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacgacgactggagattaaccgaactgtggctgcaccatctgtcttcatcttccccg

SEQ ID NO: 536595 - DNA, 494 bp, Homo sapiens
  misc_feature: HIJSMM301ASOFG.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaaggaccgaaagtaggacgatacaagcgaactagtggcgtgcgaccatct

SEQ ID NO: 536596 - DNA, 488 bp, Homo sapiens
  misc_feature: HIJSMM301DY1HU.49.86.H09.1.454.light.4.raw
  modified_base (461)..(461): a, c, t, g, unknown or other
agtcgagagacacgaccggtgctcgatttagtgctatagacttgggtttggggctgtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcgggcggagggaccgaanctgacccgtcctaaggtcaggccccaa

SEQ ID NO: 536597 - DNA, 486 bp, Homo sapiens; identical to SEQ ID NO: 535043
  misc_feature: HIJSMM301CVBN1.46.35.D02.1.454.light.4.raw

SEQ ID NO: 536598 - DNA, 490 bp, Homo sapiens
  misc_feature: HIJSMM301B5ZHJ.49.67.G01.1.454.light.4.raw
agtcgagagacacgaccggtgctcgatttagagtatacatattgggtttgggggaggaactgctcagttaggacccagagggaaccatggaagcccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccagggaccaagctggaaatcagacgaactgtggctgcaccat

SEQ ID NO: 536599 - DNA, 498 bp, Homo sapiens
  misc_feature: HIJSMM301BT8QB.43.34.D01.1.454.light.4.raw
tgtgagtagtcacgaccggtgctcgatttagatcgtctgtgttgaggtttgggggctttgcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcagggtttctgatcgcttctctggctccaagtctggcaacacggcctccctgacaatctctgggctccaggctgaggacgaggctgattattattgctgctcatatgcaggtagttacacttatgttcttcggaattgggacgacggtcaccgtcctaggtcagcccaaggcccaacccactgtcactctgttcccaccctcctcactactca

SEQ ID NO: 536600 - DNA, 447 bp, Homo sapiens; identical to SEQ ID NO: 535201
  misc_feature: HIJSMM301B0ZTJ.18.9.A09.1.454.light.4.raw

SEQ ID NO: 536601 - DNA, 514 bp, Homo sapiens
  misc_feature: HIJSMM301EAWRC.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggccccaaactcctcatctataggaataatcagcggccctcaggggtccctgaccgattctctggctccaaggctggcacctcagcctccctggccatcagtgggctccggtcgaggatgaggctgattattactgtgcagcatgggatgacagcctgagtggtccttgggtgttcggcggaggaccaagctgaccgtcctaagtcagcccaaggctcgccccctcggtcactctcgttcccaccctcctcg

SEQ ID NO: 536602 - DNA, 488 bp, Homo sapiens
  misc_feature: HIJSMM301CDMRY.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggacccaaggtggagatcaaacgtaacg

SEQ ID NO: 536603 - DNA, 484 bp, Homo sapiens
  misc_feature: HIJSMM301BSJK5.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcggacctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 536604 - DNA, 502 bp, Homo sapiens
  misc_feature: HIJSMM301AIB20.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaaggacacgactggagattaaacg

SEQ ID NO: 536605 - DNA, 447 bp, Homo sapiens; identical to SEQ ID NO: 535020
  misc_feature: HIJSMM301COMBQ.18.9.A09.1.454.light.4.raw

SEQ ID NO: 536606 - DNA, 468 bp, Homo sapiens
  misc_feature: HIJSMM301ERBR6.51.1.A01.1.454.light.4.raw
cgatcgtatacacgaccggtgctcgatttagacgtctcatcaggggaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaagcccctaagctcctgatcctcgatgcatccaatttggaaacagggtcccatcaaggttcagtgcaagtggctctgggacagatttcactttcaccatcagcagactgcagcctgaagatattgcaacatattactgtcaacagtatgataatctcccgctcactttcggcggagggaccaaggtggggagtcaaacgaactgt

SEQ ID NO: 536607 - DNA, 497 bp, Homo sapiens; identical to SEQ ID NO: 536371
  misc_feature: HIJSMM301C1DWH.16.78.H01.1.454.light.4.raw

SEQ ID NO: 536608 - DNA, 501 bp, Homo sapiens
  misc_feature: HIJSMM301A1CDK.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctggaccaagtggatatcaaacgaactgtggctgcaccatctgt

SEQ ID NO: 536609 - DNA, 414 bp, Homo sapiens
  misc_feature: HIJSMM301DWEJ8.16.46.E02.1.454.light.4.raw
tgtactactccacgaccggtgctcgatttagactcatctacagggaaaggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcactctgttcccgccctcctcgagtagtaca

SEQ ID NO: 536610 - DNA, 443 bp, Homo sapiens
  misc_feature: HIJSMM301ET7FN.17.11.A11.1.454.light.4.raw
cgtagactagcacgaccggtgctcgatttagctacgactgcagggagagtggagactgagtcatcacaacatctccactctccctgcccgtcactcttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtggctgcaccatctgtcttcatcttcccgccatctgactagtctacg

SEQ ID NO: 536611 - DNA, 493 bp, Homo sapiens
  misc_feature: HIJSMM301D3XEC.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctctacttcggtcgggagggaccgaaggcggagatcagacgaactgtggctgcaccatctgtcttcta

SEQ ID NO: 536612 - DNA, 495 bp, Homo sapiens; identical to SEQ ID NO: 535821
  misc_feature: HIJSMM301A498D.3.31.C09.1.454.light.4.raw

SEQ ID NO: 536613 - DNA, 494 bp, Homo sapiens
  misc_feature: HIJSMM301ERCLZ.40.59.F04.1.454.light.4.raw
tctagcgactcacgaccggtgctcgatttagtacacacacttagggattggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagttattactgtcagcagcgtaccaactggccgctcactttcggcggagggaccaaggtggagatcaaacgaactgtggctgcaccatctgtcttcat

SEQ ID NO: 536614 - DNA, 492 bp, Homo sapiens; identical to SEQ ID NO: 536010
  misc_feature: HIJSMM301AOZJO.10.20.B09.1.454.light.4.raw

SEQ ID NO: 536615 - DNA, 447 bp, Homo sapiens; identical to SEQ ID NO: 535882
  misc_feature: HIJSMM301CTPXU.18.9.A09.1.454.light.4.raw
  modified_base (429)..(429): a, c, t, g, unknown or other

SEQ ID NO: 536616 - DNA, 487 bp, Homo sapiens; identical to SEQ ID NO: 535508
  misc_feature: HIJSMM301AHSUL.13.87.H10.1.454.light.4.raw

SEQ ID NO: 536617 - DNA, 505 bp, Homo sapiens; identical to SEQ ID NO: 536233
  misc_feature: HIJSMM301CXJ3F.48.25.C03.1.454.light.4.raw

SEQ ID NO: 536618 - DNA, 503 bp, Homo sapiens
  misc_feature: HIJSMM301A5WVC.10.82.H05.1.454.light.4.raw
catagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatcccaggaggtgcccccaaactcctcatatatgaagatgataagcgaccgtcagggattcctgaccgattctctggctccaagtctggcacgtcggccaccctgggcatcgccggactccagactggggacgaggccgatttttactgcggaacatgggataccagcctgcatggtgtggttttcggcggagggaccaagctgaccgtcctaagtcagcccaaggctgccccc

SEQ ID NO: 536619 - DNA, 492 bp, Homo sapiens; identical to SEQ ID NO: 535335
  misc_feature: HIJSMM301BOQ7U.16.53.E09.1.454.light.4.raw

SEQ ID NO: 536620 - DNA, 480 bp, Homo sapiens
  misc_feature: HIJSMM301BIPTR.19.71.G05.1.454.light.4.raw
  modified_base (474)..(474): a, c, t, g, unknown or other
tactctcgtgcacgaccggtgctcgatttagtgtcgtcgcaagagagagggggaggtacaacaggcaggcaggggcgagcaagaatggtgttgcagacccaggtcttcatttcttctgttgctctggatctctggtgcccacgggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttgccaggaccagtggatatnagagaa

SEQ ID NO: 536621 - DNA, 490 bp, Homo sapiens; identical to SEQ ID NO: 535526
  misc_feature: HIJSMM301CZEOM.26.78.H01.1.454.light.4.raw

SEQ ID NO: 536622 - DNA, 482 bp, Homo sapiens
  misc_feature: HIJSMM301DY4M0.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtcag

SEQ ID NO: 536623 - DNA, 494 bp, Homo sapiens; identical to SEQ ID NO: 535276
  misc_feature: HIJSMM301CQWTK.16.6.A06.1.454.light.4.raw

SEQ ID NO: 536624 - DNA, 494 bp, Homo sapiens; identical to SEQ ID NO: 534992
  misc_feature: HIJSMM301CMTKR.9.1.A01.1.454.light.4.raw

SEQ ID NO: 536625 - DNA, 474 bp, Homo sapiens; identical to SEQ ID NO: 535264
  misc_feature: HIJSMM301DMR3S.13.76.G10.1.454.light.4.raw

SEQ ID NO: 536626 - DNA, 480 bp, Homo sapiens
  misc_feature: HIJSMM301DN0HF.13.34.D01.1.454.light.4.raw
tcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacggactggagattaaaggaa

SEQ ID NO: 536627 - DNA, 453 bp, Homo sapiens; identical to SEQ ID NO: 536441
  misc_feature: HIJSMM301CKTVT.19.86.H09.1.454.light.4.raw

SEQ ID NO: 536628 - DNA, 480 bp, Homo sapiens; identical to SEQ ID NO: 535442
  misc_feature: HIJSMM301CWIVX.41.17.B06.1.454.light.4.raw

SEQ ID NO: 536629 - DNA, 493 bp, Homo sapiens
  misc_feature: HIJSMM301BXWDR.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaataccaggcggccctctggggtccctcgagcgattctccggctccggctctgggaacacagtcactctgaccatcagcgggacccacggctattgatgaggctgtctacttctgtcaggcgtgggacaacagcgtggtgttcggcggagggaccgagtctgaccgtccttaggtcagcccaaggctgccccctccggtcact

SEQ ID NO: 536630 - DNA, 485 bp, Homo sapiens
  misc_feature: HIJSMM301DK0UR.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctccgtacatgtacacttttggccaggggaccaacctggagat

SEQ ID NO: 536631 - DNA, 507 bp, Homo sapiens
  misc_feature: HIJSMM301B8PF7.12.28.C06.1.454.light.4.raw
atacgacgtacacgaccggtgctcgatttagagctcacgtattgggtttggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccacggaccgacacgtagaatagagacgaactagtggcgtgcgaccactctgtcttctactcttcccgt

SEQ ID NO: 536632 - DNA, 476 bp, Homo sapiens
  misc_feature: HIJSMM301AT5G7.52.1.A01.1.454.light.4.raw
cgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcacc

SEQ ID NO: 536633 - DNA, 463 bp, Homo sapiens; identical to SEQ ID NO: 535008
  misc_feature: HIJSMM301BSULG.10.9.A09.1.454.light.4.raw

SEQ ID NO: 536634 - DNA, 500 bp, Homo sapiens
  misc_feature: HIJSMM301COEJQ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaaggtggatatacagacgaaactagtgggctg

SEQ ID NO: 536635 - DNA, 415 bp, Homo sapiens; identical to SEQ ID NO: 536482
  misc_feature: HIJSMM301DR78Z.16.46.E02.1.454.light.4.raw

SEQ ID NO: 536636 - DNA, 485 bp, Homo sapiens; identical to SEQ ID NO: 536040
  misc_feature: HIJSMM301CDPQ5.15.1.A01.1.454.light.4.raw

SEQ ID NO: 536637 - DNA, 505 bp, Homo sapiens
  misc_feature: HIJSMM301ADLY6.9.67.G01.1.454.light.4.raw
tgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtgggtctgggacagagttcgttctcaccatcagcagcctgcagtctgaagattttgaagtttattactgtcagcactataatagttggccgctcactttcggcggagggaccgaaggtggagctcaaacgaactgtggctgcaccatctgtcttctatcttccccg

SEQ ID NO: 536638 - DNA, 447 bp, Homo sapiens; identical to SEQ ID NO: 535201
  misc_feature: HIJSMM301D7EAJ.18.9.A09.1.454.light.4.raw

SEQ ID NO: 536639 - DNA, 486 bp, Homo sapiens; identical to SEQ ID NO: 535917
  misc_feature: HIJSMM301AHV9O.3.10.A10.1.454.light.4.raw

SEQ ID NO: 536640 - DNA, 464 bp, Homo sapiens
  misc_feature: HIJSMM301DVITN.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtcttcatcttcccgccatctgaagtatagtct

SEQ ID NO: 536641 - DNA, 495 bp, Homo sapiens
  misc_feature: HIJSMM301BJFMQ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctcgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 536642 - DNA, 454 bp, Homo sapiens
  misc_feature: HIJSMM301B0WT9.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctgacgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 536643 - DNA, 484 bp, Homo sapiens
  misc_feature: HIJSMM301AHC36.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccggcagagggtcgtcatctcttgctctggaagcagctccaacatcggaaggaatgatgtgtactggttgcagcaactccccggaacggccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaaactgaccgtcctaggtcagcccaaggctgccccctcggtcactctgttcccaccctcctctacgtgagct

SEQ ID NO: 536644 - DNA, 517 bp, Homo sapiens
  misc_feature: HIJSMM301AJV97.48.27.C05.1.454.light.4.raw
agtatacatacacgaccggtgctcgatttagacgcgatcgaagggtttggggagcttcagctgtggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgccgattctctggctccaagtctggcaccacagcctccctggccatcagaggactccggtccgaggatgagggtgatttttattgtgctgtttgggatgacgacatgaatggttcgtattttcggcggagggaccaaactgaccgtcctgggtcagcccaaggctcgccccctcggtcactc

SEQ ID NO: 536645 - DNA, 490 bp, Homo sapiens
  misc_feature: HIJSMM301CD3KQ.26.78.H01.1.454.light.4.raw
agactatactcacgaccggtgctcgatttagtgtgagtagtttgggtttgggggagaaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgt

SEQ ID NO: 536646 - DNA, 487 bp, Homo sapiens
  misc_feature: HIJSMM301AUSER.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggataatcagacgaa

SEQ ID NO: 536647 - DNA, 505 bp, Homo sapiens
  misc_feature: HIJSMM301AZTPL.3.53.E09.1.454.light.4.raw
agacgcactccacgaccggtgctcgatttagagagagtgtgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaaaaagaactacttaggttggtaccagcagaaaccagggcagcctcctaagctgctcattacctgggcatctacccgggaatctggggtccctgaccgattcagtggcagcgggtctgggacagatttcactctcaccatcaccaacctgcaggctgaagatgtggccgtttattactgtcagcaatattatggtactcctccgtggacgttcggccaagggaccaaggtggaaatacaaacgaactagtggctgcaccat

SEQ ID NO: 536648 - DNA, 447 bp, Homo sapiens; identical to SEQ ID NO: 535201
  misc_feature: HIJSMM301BIW28.18.9.A09.1.454.light.4.raw

SEQ ID NO: 536649 - DNA, 444 bp, Homo sapiens; identical to SEQ ID NO: 535027
  misc_feature: HIJSMM301BXAHZ.8.73.G07.1.454.light.4.raw

SEQ ID NO: 536650 - DNA, 495 bp, Homo sapiens
  misc_feature: HIJSMM301BYFJU.11.81.H04.1.454.light.4.raw
  modified_base (403)..(403): a, c, t, g, unknown or other
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttacngtcagcagtatagtaactggcctccgtacacttttggccaggggaccaagctagaaatacaaacgaactgtggctgcaccatctgtcttcta

SEQ ID NO: 536651 - DNA, 496 bp, Homo sapiens
  misc_feature: HIJSMM301EUZ91.15.25.C03.1.454.light.4.raw
tctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactgtggctgcacc

SEQ ID NO: 536652 - DNA, 504 bp, Homo sapiens
  misc_feature: HIJSMM301CIEYK.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctaccaagctgaggatgaggctgattattactgcagctcatatgcaggcagcagcaatgttactttcggcggaggaccaagctgaccgtcctgggtcagcccaaggctcgccccctcggtca

SEQ ID NO: 536653 - DNA, 486 bp, Homo sapiens
  misc_feature: HIJSMM301DQP3W.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttatcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 536654 - DNA, 453 bp, Homo sapiens
  misc_feature: HIJSMM301AGKPI.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgcccctcggtcactctgttcccgccctcctccacgagagta

SEQ ID NO: 536655 - DNA, 415 bp, Homo sapiens
  misc_feature: HIJSMM301CEXA3.18.78.H01.1.454.light.4.raw
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctcttgctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccaccctcctccatactcgta

SEQ ID NO: 536656 - DNA, 497 bp, Homo sapiens; identical to SEQ ID NO: 536371
  misc_feature: HIJSMM301D3F0G.16.78.H01.1.454.light.4.raw

SEQ ID NO: 536657 - DNA, 416 bp, Homo sapiens
  misc_feature: HIJSMM301CJP4J.16.46.E02.1.454.light.4.raw
tgtactactccacgaccggtgctcgatttagactcatctacagggaaaggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccgccctcctcgagtagtaca

SEQ ID NO: 536658 - DNA, 505 bp, Homo sapiens
  misc_feature: HIJSMM301D4Q6Y.5.24.C02.1.454.light.4.raw
atcagacacgcacgaccggtgctcgatttagtacagatcgttagggaaaggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgccccccg

SEQ ID NO: 536659 - DNA, 485 bp, Homo sapiens; identical to SEQ ID NO: 535822
  misc_feature: HIJSMM301ARD1N.14.53.E09.1.454.light.4.raw

SEQ ID NO: 536660 - DNA, 486 bp, Homo sapiens; identical to SEQ ID NO: 535043
  misc_feature: HIJSMM301AR0UC.46.35.D02.1.454.light.4.raw

SEQ ID NO: 536661 - DNA, 524 bp, Homo sapiens
  misc_feature: HIJSMM301AG0VF.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaaggtcaccgtcctaggtcagcccaacggccaaccccacctgtcactctgttcccgccctcctccgtgt

SEQ ID NO: 536662 - DNA, 474 bp, Homo sapiens
  misc_feature: HIJSMM301C4LJG.40.59.F04.1.454.light.4.raw
tctagcgactcacgaccggtgctcgatttagtacacacacttagggattggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagccc

SEQ ID NO: 536663 - DNA, 489 bp, Homo sapiens
  misc_feature: HIJSMM301DLLRT.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtggagatcaaacgaactgtggctgcaccat

SEQ ID NO: 536664 - DNA, 493 bp, Homo sapiens
  misc_feature: HIJSMM301AKAUP.51.6.A06.1.454.light.4.raw
  modified_base (397)..(397): a, c, t, g, unknown or other
  modified_base (481)..(481): a, c, t, g, unknown or other
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttcngtcaatcttcagacatcagtggtacttatgtcttcggaactgggaccaaggtcaccgtcctaggtcagcccaaggccaaccccnctgtcactctcg

SEQ ID NO: 536665 - DNA, 483 bp, Homo sapiens
  misc_feature: HIJSMM301EUW3S.13.59.F04.1.454.light.4.raw
tcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtggctgca

SEQ ID NO: 536666 - DNA, 507 bp, Homo sapiens
  misc_feature: HIJSMM301ENSH2.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttccgcc

SEQ ID NO: 536667 - DNA, 508 bp, Homo sapiens
  misc_feature: HIJSMM301COISK.15.59.F04.1.454.light.4.raw
  modified_base (473)..(473): a, c, t, g, unknown or other
tctacgtagccacgaccggtgctcgatttagtacacacacttagggattggggggaaggcctgagaacacttagccttcatgagtgtccccacccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatggtgctggcaatttcggtcttcggcggagggaccaagctnaccgtcctaggtcagcccaaggctgccccctcggt

SEQ ID NO: 536668 - DNA, 484 bp, Homo sapiens; identical to SEQ ID NO: 535400
  misc_feature: HIJSMM301DRRQJ.46.26.C04.1.454.light.4.raw

SEQ ID NO: 536669 - DNA, 494 bp, Homo sapiens; identical to SEQ ID NO: 534994
  misc_feature: HIJSMM301BXW79.27.78.H01.1.454.light.4.raw

SEQ ID NO: 536670 - DNA, 455 bp, Homo sapiens
  misc_feature: HIJSMM301D5AQ4.19.86.H09.1.454.light.4.raw
tactctcgtgcacgaccggtgctcgatttagtgctatagacttgggtttgggggccgttcctgggcccagtctgtgctgactcaggcaccctcagcgtctggggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtcttgcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 536671 - DNA, 492 bp, Homo sapiens
  misc_feature: HIJSMM301ANOT2.9.34.D01.1.454.light.4.raw
tgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtccg

SEQ ID NO: 536672 - DNA, 507 bp, Homo sapiens
  misc_feature: HIJSMM301A7Q35.17.33.C11.1.454.light.4.raw
cgtagactagcacgaccggtgctcgatttagagtgagctcgttgggtttgggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtgtgctgtgctattcggcggagggaccaagctgaccgtcttaagtcagcccaaggctgccccctcggtcactctgttccca

SEQ ID NO: 536673 - DNA, 494 bp, Homo sapiens
  misc_feature: HIJSMM301CM5VV.15.59.F04.1.454.light.4.raw
tctacgtagccacgaccggtgctcgatttagtacacacacttagggattggggccgtggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcactctgttcccgccctcctcgctacgtaga

SEQ ID NO: 536674 - DNA, 446 bp, Homo sapiens
  misc_feature: HIJSMM301CLXUU.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtcccgtgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccacccctcctccgtgtctgat

SEQ ID NO: 536675 - DNA, 447 bp, Homo sapiens; identical to SEQ ID NO: 535201
  misc_feature: HIJSMM301A6FNC.18.9.A09.1.454.light.4.raw

SEQ ID NO: 536676 - DNA, 444 bp, Homo sapiens; identical to SEQ ID NO: 535594
  misc_feature: HIJSMM301BPLNB.9.9.A09.1.454.light.4.raw

SEQ ID NO: 536677 - DNA, 495 bp, Homo sapiens; identical to SEQ ID NO: 536055
  misc_feature: HIJSMM301CI8T9.47.38.D05.1.454.light.4.raw

SEQ ID NO: 536678 - DNA, 485 bp, Homo sapiens
  misc_feature: HIJSMM301BF7RV.49.3.A03.1.454.light.4.raw
agtcgagagacacgaccggtgctcgatttagagagcgtcacagggggaggaactgctcagttaggacccagacgtaaccatggaagccccagcgcagcttctcttcctcctgctactctggctcccagataccactggagaaatagtgatgacgcagtctccagccactttgtctgtgtctccaggggagagagccactctctcctgcaggaccagtcagagtgttaataacaagttagcctggtaccagcagagacctggccaggctcccaggctcctcatctatgatgtgtctaccagggccactggtatcccagccaggttcagtggcagtgggtctggggcggagttcactctcaccatcagcagcctgcagtctgaagattttgcagtttattactgtcagcactctaatgactggcccctgtacacttttggcccgggaccaaggtggagatcaaacgaactgtggctgcaccatctgt

SEQ ID NO: 536679 - DNA, 479 bp, Homo sapiens
  misc_feature: HIJSMM301BPUMJ.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagtttggccaggggaccaagctggagatcaaacgaa

SEQ ID NO: 536680 - DNA, 501 bp, Homo sapiens
  misc_feature: HIJSMM301B8VVA.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcataggtcagcccc

SEQ ID NO: 536681 - DNA, 488 bp, Homo sapiens; identical to SEQ ID NO: 535169
  misc_feature: HIJSMM301DYO11.16.72.G06.1.454.light.4.raw

SEQ ID NO: 536682 - DNA, 485 bp, Homo sapiens
  misc_feature: HIJSMM301AW16A.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggaggacaagctgaccgtcctaggtcacgcccaaggctcgccccctcggtcta

SEQ ID NO: 536683 - DNA, 487 bp, Homo sapiens
  misc_feature: HIJSMM301AZ502.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcgagggaccaaggtggagatcaaacgaactgtggctgcaccat

SEQ ID NO: 536684 - DNA, 444 bp, Homo sapiens; identical to SEQ ID NO: 535027
  misc_feature: HIJSMM301BWRMQ.8.73.G07.1.454.light.4.raw

SEQ ID NO: 536685 - DNA, 444 bp, Homo sapiens
  misc_feature: HIJSMM301BWVIP.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgccctcctccactactatg

SEQ ID NO: 536686 - DNA, 494 bp, Homo sapiens; identical to SEQ ID NO: 534992
  misc_feature: HIJSMM301A2V3M.9.1.A01.1.454.light.4.raw

SEQ ID NO: 536687 - DNA, 501 bp, Homo sapiens; identical to SEQ ID NO: 535746
  misc_feature: HIJSMM301CJOC2.18.11.A11.1.454.light.4.raw

SEQ ID NO: 536688 - DNA, 453 bp, Homo sapiens; identical to SEQ ID NO: 536065
  misc_feature: HIJSMM301E1BDI.18.78.H01.1.454.light.4.raw

SEQ ID NO: 536689 - DNA, 490 bp, Homo sapiens
  misc_feature: HIJSMM301EEM4G.16.68.G02.1.454.light.4.raw
tgtactactccacgaccggtgctcgatttagtcgatagtgaagggaaaggggagtcagacccacgtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcat

SEQ ID NO: 536690 - DNA, 496 bp, Homo sapiens
  misc_feature: HIJSMM301AGA0Y.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcat

SEQ ID NO: 536691 - DNA, 483 bp, Homo sapiens
  misc_feature: HIJSMM301B0HNN.17.26.C04.1.454.light.4.raw
cgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcacc

SEQ ID NO: 536692 - DNA, 494 bp, Homo sapiens; identical to SEQ ID NO: 535828
  misc_feature: HIJSMM301ED869.3.36.D03.1.454.light.4.raw

SEQ ID NO: 536693 - DNA, 491 bp, Homo sapiens
  misc_feature: HIJSMM301AS3QZ.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaaactccctcaacgttcggcggagggaccaaggtggagatcaaacgaactgtggctgcaccatctgtcttc

SEQ ID NO: 536694 - DNA, 486 bp, Homo sapiens; identical to SEQ ID NO: 536555
  misc_feature: HIJSMM301EQ2OI.26.23.C01.1.454.light.4.raw

SEQ ID NO: 536695 - DNA, 485 bp, Homo sapiens
  misc_feature: HIJSMM301DNGAF.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtcagaccccg

SEQ ID NO: 536696 - DNA, 440 bp, Homo sapiens
  misc_feature: HIJSMM301CKNN3.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgcccctcggtcactctgttcccaccctcctcgtatctctcg

SEQ ID NO: 536697 - DNA, 483 bp, Homo sapiens
  misc_feature: HIJSMM301ARSKB.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggaggaccaaggtggagatcaaacgaa

SEQ ID NO: 536698 - DNA, 505 bp, Homo sapiens
  misc_feature: HIJSMM301ET7L2.43.53.E09.1.454.light.4.raw
tgtgagtagtcacgaccggtgctcgatttagagagagtgtgttgggtttgggcacgaccggtgctcgatttagagtgagctcgttgggtttggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaattcggttcgagggaccgaacttagtacaa

SEQ ID NO: 536699 - DNA, 497 bp, Homo sapiens; identical to SEQ ID NO: 536376
  misc_feature: HIJSMM301ETL1I.22.9.A09.1.454.light.4.raw

SEQ ID NO: 536700 - DNA, 444 bp, Homo sapiens; identical to SEQ ID NO: 534993
  misc_feature: HIJSMM301BSTVK.5.9.A09.1.454.light.4.raw

SEQ ID NO: 536701 - DNA, 494 bp, Homo sapiens; identical to SEQ ID NO: 535629
  misc_feature: HIJSMM301CSNQP.4.27.C05.1.454.light.4.raw

SEQ ID NO: 536702 - DNA, 445 bp, Homo sapiens
  misc_feature: HIJSMM301EIZVJ.7.18.B07.1.454.light.4.raw
cgtgtctctacacgaccggtgctcgatttagtcgctgcgtaagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctctagagacaccg

SEQ ID NO: 536703 - DNA, 444 bp, Homo sapiens; identical to SEQ ID NO: 535027
  misc_feature: HIJSMM301DG3C2.8.73.G07.1.454.light.4.raw

SEQ ID NO: 536704 - DNA, 494 bp, Homo sapiens; identical to SEQ ID NO: 534994
  misc_feature: HIJSMM301B29RT.27.78.H01.1.454.light.4.raw

SEQ ID NO: 536705 - DNA, 493 bp, Homo sapiens
  misc_feature: HIJSMM301COB1G.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccaaggtggagttcaacgaactgtggctgcaccatctgtcttcatt

SEQ ID NO: 536706 - DNA, 489 bp, Homo sapiens; identical to SEQ ID NO: 535386
  misc_feature: HIJSMM301AF7B4.12.51.E07.1.454.light.4.raw

SEQ ID NO: 536707 - DNA, 495 bp, Homo sapiens
  misc_feature: HIJSMM301AROF5.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttacttcaccatcagcagcctgcagcctgaagatattgcaacatattactgtcaacagtatcataatctccccacctttcggtccctcgggaccgaaactagggatatcaaacgaaactcgtggctcgcaccactctgtt

SEQ ID NO: 536708 - DNA, 487 bp, Homo sapiens
  misc_feature: HIJSMM301BJLCC.4.64.F09.1.454.light.4.raw
agcactgtagcacgaccggtgctcgatttagcgcgtatacaagggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgcaacttactttgtcaacagactaactcattccctcgcagttttggccaggggaccaaggtggagatcaaacgaactgtggctgcaccatctgtcttcatt

SEQ ID NO: 536709 - DNA, 489 bp, Homo sapiens
  misc_feature: HIJSMM301AG9Z2.16.68.G02.1.454.light.4.raw
tgtactactccacgaccggtgctcgatttagtcgatagtgaagggaaaggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcat

SEQ ID NO: 536710 - DNA, 488 bp, Homo sapiens
  misc_feature: HIJSMM301BQH38.21.55.E11.1.454.light.4.raw
tcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacacctttttaaattggtatcagcacaaaccagggaaggccccaaagctcctgatcgatgctgcatccaatttagagagtggggtcccatccaggttcagtggcgatggatctgggacaaatttcactctcaccatcagcagtctgcaacctgaagattttgcaacttactattgtcaacagagttacagtattcctttcactttcggccctgggaccgaagtcgatatcaaacgaactgtggctgcaccatctgt

SEQ ID NO: 536711 - DNA, 497 bp, Homo sapiens; identical to SEQ ID NO: 535740
  misc_feature: HIJSMM301A2GZQ.3.71.G05.1.454.light.4.raw

SEQ ID NO: 536712 - DNA, 448 bp, Homo sapiens
  misc_feature: HIJSMM301B96AR.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccaggggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 536713 - DNA, 444 bp, Homo sapiens; identical to SEQ ID NO: 535027
  misc_feature: HIJSMM301AVYDJ.8.73.G07.1.454.light.4.raw

SEQ ID NO: 536714 - DNA, 485 bp, Homo sapiens; identical to SEQ ID NO: 536040
  misc_feature: HIJSMM301BZR1T.15.1.A01.1.454.light.4.raw

SEQ ID NO: 536715 - DNA, 441 bp, Homo sapiens; identical to SEQ ID NO: 534971
  misc_feature: HIJSMM301BMEFU.11.3.A03.1.454.light.4.raw

SEQ ID NO: 536716 - DNA, 444 bp, Homo sapiens; identical to SEQ ID NO: 534993
  misc_feature: HIJSMM301BDMLO.5.9.A09.1.454.light.4.raw

SEQ ID NO: 536717 - DNA, 491 bp, Homo sapiens
  misc_feature: HIJSMM301A7A98.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgcccagatgtgacagtccagttgaacccgagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgtcttc

SEQ ID NO: 536718 - DNA, 493 bp, Homo sapiens; identical to SEQ ID NO: 535047
  misc_feature: HIJSMM301BAN3C.16.53.E09.1.454.light.4.raw

SEQ ID NO: 536719 - DNA, 454 bp, Homo sapiens; identical to SEQ ID NO: 534964
  misc_feature: HIJSMM301DYH6G.19.86.H09.1.454.light.4.raw

SEQ ID NO: 536720 - DNA, 442 bp, Homo sapiens
  misc_feature: HIJSMM301A5W7B.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtcccgtgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccgccctcctcgtatctctcg

SEQ ID NO: 536721 - DNA, 512 bp, Homo sapiens
  misc_feature: HIJSMM301D5YXL.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaacccactgtcact

SEQ ID NO: 536722 - DNA, 513 bp, Homo sapiens
  misc_feature: HIJSMM301BOTE2.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccaacgggaccgaacggtggaaagtacaagacgaaactagtggctggcaccactctgtcttctatcttcccgt

SEQ ID NO: 536723 - DNA, 485 bp, Homo sapiens
  misc_feature: HIJSMM301B221C.5.40.D07.1.454.light.4.raw
atcagacacgcacgaccggtgctcgatttagtgatagagcgtaacaacagagggggaggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggaccaaggtggagaccaaacgaactgtggctgcaccat

SEQ ID NO: 536724 - DNA, 489 bp, Homo sapiens
  misc_feature: HIJSMM301BWHT2.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattcttccagcgttcggccagggaccaaggtggaagtcaagcgaactgtggctgcaccatctgtt

SEQ ID NO: 536725 - DNA, 454 bp, Homo sapiens
  misc_feature: HIJSMM301D0L2Q.19.86.H09.1.454.light.4.raw
  modified_base (436)..(436): a, c, t, g, unknown or other
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccnccctcctccacgagagta

SEQ ID NO: 536726 - DNA, 489 bp, Homo sapiens
  misc_feature: HIJSMM301DA4NG.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcgccgaaggaccgaaggtggaacgtacaaacgaa

SEQ ID NO: 536727 - DNA, 515 bp, Homo sapiens
  misc_feature: HIJSMM301A8PX0.48.41.D08.1.454.light.4.raw
agtatacatacacgaccggtgctcgatttagtcacgcgagaaagggaaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccacct

SEQ ID NO: 536728 - DNA, 504 bp, Homo sapiens
  misc_feature: HIJSMM301AMU5L.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccccactgtca

SEQ ID NO: 536729 - DNA, 489 bp, Homo sapiens; identical to SEQ ID NO: 535386
  misc_feature: HIJSMM301ET5GH.12.51.E07.1.454.light.4.raw

SEQ ID NO: 536730 - DNA, 506 bp, Homo sapiens; identical to SEQ ID NO: 536045
  misc_feature: HIJSMM301EJ1ER.9.12.B01.1.454.light.4.raw

SEQ ID NO: 536731 - DNA, 497 bp, Homo sapiens
  misc_feature: HIJSMM301DZL78.9.1.A01.1.454.light.4.raw
tgatacgtctcacgaccggtgctcgatttagacgtctcatcagggggagctgctcagttaggacccacgagggaaccatggaaaccccaacgcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 536732 - DNA, 494 bp, Homo sapiens
  misc_feature: HIJSMM301EHKB1.4.38.D05.1.454.light.4.raw
agcactgtagcacgaccggtgctcgatttagtatctgatagttgggtttgggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaacctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtgtggtagctcaccgacgttcggccaagggaccaacggtaggaaatcaaacgaaactgtggctgcaccatctgtt

SEQ ID NO: 536733 - DNA, 492 bp, Homo sapiens
  misc_feature: HIJSMM301AJMT2.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactgtggctgcaccatctgtcttcatcttcccgccat

SEQ ID NO: 536734 - DNA, 494 bp, Homo sapiens; identical to SEQ ID NO: 534994
  misc_feature: HIJSMM301BIV9V.27.78.H01.1.454.light.4.raw

SEQ ID NO: 536735 - DNA, 447 bp, Homo sapiens; identical to SEQ ID NO: 535201
  misc_feature: HIJSMM301EF0MV.18.9.A09.1.454.light.4.raw

SEQ ID NO: 536736 - DNA, 489 bp, Homo sapiens
  misc_feature: HIJSMM301DXKN5.43.20.B09.1.454.light.4.raw
tgtgagtagtcacgaccggtgctcgatttagtgtagtgtgaagggggaagagctgctcagttaggacccagagggaaccatggaaaccccagcgcagcttctcttcctcctgctactctggctcccagataccaccggagaaattgtgttgacgcagtctccgggcaccctgtctttgtctccaggggatagagccaccctctcctgcagggccagtcagagtgttagcagcacctacttagcctggtaccagcagaaacctggccaggctcccaggctcctcatctatgatgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 536737 - DNA, 502 bp, Homo sapiens
  misc_feature: HIJSMM301BLSGG.18.59.F04.1.454.light.4.raw
tacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagtagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaaccca

SEQ ID NO: 536738 - DNA, 494 bp, Homo sapiens; identical to SEQ ID NO: 535828
  misc_feature: HIJSMM301AJXBK.3.36.D03.1.454.light.4.raw

SEQ ID NO: 536739 - DNA, 512 bp, Homo sapiens
  misc_feature: HIJSMM301BTXNJ.48.14.B03.1.454.light.4.raw
agtatacatacacgaccggtgctcgatttagtgtgagtagttccgcggggactgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtcggaataaaacgaactagtggctgcaccatctgtcttcta

SEQ ID NO: 536740 - DNA, 505 bp, Homo sapiens
  misc_feature: HIJSMM301D7M14.43.4.A04.1.454.light.4.raw
tgtgagtagtcacgaccggtgctcgatttagagtagtgatcagggtcattaatgtcagcggcacagcaaccgcgggcactttcggcggagggaccaaggtggagatcaagcgtgagtgcactttcctagtgctttttcttataaggcctgaaatttggagtctttttgtgtttgagacattacctcaggtccattccagagagttccagaggtccattccagagagttccagaggctttacaaaaggtccgatgagtaagggatcgaaagttagtccatcttaaggagcagccaagcgctggtcagttaagagcggcgcctcatttgcaagattttctctgcgtcggccaggttagtgatcttcacgacgaaaagactatttttctgagggaaaagtaattaagttaatgttgtggatcagcttcggccaagggacgcgactggagattaaacgaactgtggctgcaccatctgtcttcatcttcccgcatctgaactactcaca

SEQ ID NO: 536741 - DNA, 496 bp, Homo sapiens
  misc_feature: HIJSMM301EQDJ9.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgctagtttattactgtcagcagtataatgacttgggttttattcactttcggtccctcgggaccaaagtggatttcagacgaactgtggctgcaccatctgtcttcta

SEQ ID NO: 536742 - DNA, 488 bp, Homo sapiens
  misc_feature: HIJSMM301BY92Z.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccaaggtggagatcaaacgaactgtggctgcaccatct

SEQ ID NO: 536743 - DNA, 461 bp, Homo sapiens
  misc_feature: HIJSMM301DD2PV.49.4.A04.1.454.light.4.raw
agtcgagagacacgaccggtgctcgatttagagtagtgatcagggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttacttcaccatcagcaggctgcagcctgaagatattgcaacatattactgtcaacagtatgatcgcctcccgctcactttcggcgggggaccgaaggtggagatcaagcgaa

SEQ ID NO: 536744 - DNA, 441 bp, Homo sapiens
  misc_feature: HIJSMM301CXA1C.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgtttccaccctcctcgtatctctcg

SEQ ID NO: 536745 - DNA, 447 bp, Homo sapiens
  misc_feature: HIJSMM301CNXGG.2.76.G10.1.454.light.4.raw
acgctcgacacacgaccggtgctcgatttagtcactcatacagggtcctgggcccagtctgtgctgactcagccaccctcagcgtctgggccccccggcagagggtctccatctcttgttctggagtcacttccaacatcggaaataatgatgtgagctggtaccagcaggtcccaggaacggcccccaaacctcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttggacccgtcctaagtcagcccaaggctgccccctcggtcactctgttcccaccctcctctgtccgagcgt

SEQ ID NO: 536746 - DNA, 490 bp, Homo sapiens
  misc_feature: HIJSMM301BEPGU.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaagacgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtggctgca

SEQ ID NO: 536747 - DNA, 496 bp, Homo sapiens; identical to SEQ ID NO: 535423
  misc_feature: HIJSMM301ARUYL.3.33.C11.1.454.light.4.raw

SEQ ID NO: 536748 - DNA, 491 bp, Homo sapiens
  misc_feature: HIJSMM301BZ2V0.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcatggacgttcggccaagggaccaaggtggatatcagacgaactgtgg

SEQ ID NO: 536749 - DNA, 494 bp, Homo sapiens; identical to SEQ ID NO: 534994
  misc_feature: HIJSMM301DSHPT.27.78.H01.1.454.light.4.raw

SEQ ID NO: 536750 - DNA, 443 bp, Homo sapiens
  misc_feature: HIJSMM301DNPDO.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccaccctcctccgtgtcgat

SEQ ID NO: 536751 - DNA, 478 bp, Homo sapiens; identical to SEQ ID NO: 535129
  misc_feature: HIJSMM301AUWDD.11.11.A11.1.454.light.4.raw

SEQ ID NO: 536752 - DNA, 494 bp, Homo sapiens
  misc_feature: HIJSMM301AYJW2.51.71.G05.1.454.light.4.raw
cgatcgtatacacgaccggtgctcgatttagtgtcgtcgcaagagagagggggtgggtccaggaggacgagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtca

SEQ ID NO: 536753 - DNA, 460 bp, Homo sapiens
  misc_feature: HIJSMM301BZH5P.11.86.H09.1.454.light.4.raw
cgagagataccacgaccggtgctcgatttagtgctatagacttgggtttgggggccgttcctgggcccagtctgtgctgactcagccaccctcagcgtctgggacccccggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccgaagctgaccgtcctaggtcagcccaaggctgccccctcggtcactctgttcccaccctcctcgtatctctcg

SEQ ID NO: 536754 - DNA, 444 bp, Homo sapiens
  misc_feature: HIJSMM301BM0XC.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtttggcaccgcagcctccctggccatcactgggctccgggctgaggatgaggctgattattactgccaggcccttgacaacagtttgggtgtttgggtgttcggcggagggaccaagctgaccgtcctgagtcagcccaaggctgccccctcggtcactctgttcccaccctcctccgtgtctgat

SEQ ID NO: 536755 - DNA, 473 bp, Homo sapiens; identical to SEQ ID NO: 535262
  misc_feature: HIJSMM301CGALM.8.67.G01.1.454.light.4.raw

SEQ ID NO: 536756 - DNA, 476 bp, Homo sapiens; identical to SEQ ID NO: 535525
  misc_feature: HIJSMM301CFHN3.8.85.H08.1.454.light.4.raw

SEQ ID NO: 536757 - DNA, 383 bp, Homo sapiens; identical to SEQ ID NO: 447524
  misc_feature: HIJSMM301BW1D7.41.26.C04.1.454.light.4.raw

SEQ ID NO: 536758 - DNA, 473 bp, Homo sapiens; identical to SEQ ID NO: 535262
  misc_feature: HIJSMM301BNF7O.8.67.G01.1.454.light.4.raw

SEQ ID NO: 536759 - DNA, 492 bp, Homo sapiens
  misc_feature: HIJSMM301B4FV3.49.17.B06.1.454.light.4.raw
agtcgagagacacgaccggtgctcgatttagtcgatagtgaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctcggtcact

SEQ ID NO: 536760 - DNA, 503 bp, Homo sapiens
  misc_feature: HIJSMM301B1XUK.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaaccccactgtcactctgttcccgccctcctcta

SEQ ID NO: 536761 - DNA, 494 bp, Homo sapiens; identical to SEQ ID NO: 536444
  misc_feature: HIJSMM301CC8N4.26.72.G06.1.454.light.4.raw

SEQ ID NO: 536762 - DNA, 434 bp, Homo sapiens
  misc_feature: HIJSMM301DXAT9.48.1.A01.1.454.light.4.raw
agtatacatacacgaccggtgctcgatttagacgtctcatcagggcaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcatcttcccgccatctgatatgtatact

SEQ ID NO: 536763 - DNA, 494 bp, Homo sapiens; identical to SEQ ID NO: 534992
  misc_feature: HIJSMM301CQDW1.9.1.A01.1.454.light.4.raw

SEQ ID NO: 536764 - DNA, 470 bp, Homo sapiens; identical to SEQ ID NO: 535302
  misc_feature: HIJSMM301B592W.13.76.G10.1.454.light.4.raw

SEQ ID NO: 536765 - DNA, 494 bp, Homo sapiens; identical to SEQ ID NO: 534994
  misc_feature: HIJSMM301DO57C.27.78.H01.1.454.light.4.raw

SEQ ID NO: 536766 - DNA, 447 bp, Homo sapiens; identical to SEQ ID NO: 535201
  misc_feature: HIJSMM301BYMRU.18.9.A09.1.454.light.4.raw

SEQ ID NO: 536767 - DNA, 444 bp, Homo sapiens; identical to SEQ ID NO: 535192
  misc_feature: HIJSMM301AH2K4.5.9.A09.1.454.light.4.raw

SEQ ID NO: 536768 - DNA, 483 bp, Homo sapiens
  misc_feature: HIJSMM301DFFG7.4.39.D06.1.454.light.4.raw
agcactgtagcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgtttcggccaggggaccaaggtcgaaatgagacgaactgtggctgcaccatctgtt

SEQ ID NO: 536769 - DNA, 493 bp, Homo sapiens
  misc_feature: HIJSMM301AMI95.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaaactccctcaacgttcggcggagggaccaaggtggagatcaaacgaactgtggctgcaccatctgtcttcta

SEQ ID NO: 536770 - DNA, 484 bp, Homo sapiens; identical to SEQ ID NO: 535400
  misc_feature: HIJSMM301BZBJW.46.26.C04.1.454.light.4.raw

SEQ ID NO: 536771 - DNA, 491 bp, Homo sapiens
  misc_feature: HIJSMM301CP8AH.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagatttgcagtttttactgtcagcagtatagtaactggcctccgtacacttttggccaggggaccaagctagaaatcaaacgaactgtggctgcaccatctgtcttc

SEQ ID NO: 536772 - DNA, 497 bp, Homo sapiens
  misc_feature: HIJSMM301AFRYT.51.83.H06.1.454.light.4.raw
cgatcgtatacacgaccggtgctcgatttagatcacgtgcgtcgcggggcagagccctggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccgaaggtggaaatacaacgaactagtggctgcacc

SEQ ID NO: 536773 - DNA, 478 bp, Homo sapiens; identical to SEQ ID NO: 535129
  misc_feature: HIJSMM301DX2PZ.11.11.A11.1.454.light.4.raw

SEQ ID NO: 536774 - DNA, 502 bp, Homo sapiens
  misc_feature: HIJSMM301BQQAQ.14.57.F02.1.454.light.4.raw
cgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaaggtggagttcaaacgaactgtggctgcaccatctgtcttcatcttcccgcc

SEQ ID NO: 536775 - DNA, 493 bp, Homo sapiens
  misc_feature: HIJSMM301A0NQX.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccaggggaccgaacggtggaaagtacaaacgaactagtggctgcacca

SEQ ID NO: 536776 - DNA, 407 bp, Homo sapiens
  misc_feature: HIJSMM301DHKX2.40.8.A08.1.454.light.4.raw
tctagcgactcacgaccggtgctcgatttagcatactctacagggagttacccgattggagggcgttatccaccatcaactgcaagtccagccagactgttttatacagctccaacaatgagaactacgttgcttggtaccagcagaaaccaggacagcctcctaagttgctcatttactgggcatctacccgggcatccggggtccctgaccgattcagtggcagcgggtctgggacagatttcactctcaccatcaacaacctgcaggctgaagatgtggcagtttattactgtcaacaatattatactactccgctcactttcggcggaggcaccaaggtggagatcagacgaactgtggctgcaccatctgtcttcatcttcccgccatctgaagtcgctaga

SEQ ID NO: 536777 - DNA, 488 bp, Homo sapiens; identical to SEQ ID NO: 535990
  misc_feature: HIJSMM301AM4K3.11.28.C06.1.454.light.4.raw

SEQ ID NO: 536778 - DNA, 480 bp, Homo sapiens; identical to SEQ ID NO: 535291
  misc_feature: HIJSMM301AGMZV.22.59.F04.1.454.light.4.raw

SEQ ID NO: 536779 - DNA, 444 bp, Homo sapiens; identical to SEQ ID NO: 535027
  misc_feature: HIJSMM301DLCUV.8.73.G07.1.454.light.4.raw

SEQ ID NO: 536780 - DNA, 488 bp, Homo sapiens; identical to SEQ ID NO: 535568
  misc_feature: HIJSMM301AR4W9.21.4.A04.1.454.light.4.raw

SEQ ID NO: 536781 - DNA, 441 bp, Homo sapiens; identical to SEQ ID NO: 535074
  misc_feature: HIJSMM301AZLUF.11.3.A03.1.454.light.4.raw

SEQ ID NO: 536782 - DNA, 503 bp, Homo sapiens
  misc_feature: HIJSMM301CM61M.48.70.G04.1.454.light.4.raw
agtatacatacacgaccggtgctcgatttagtgtagtgtgaagggaaaggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccaacgtggaaatcaaacgaactgtggctgcaccatctgt

SEQ ID NO: 536783 - DNA, 454 bp, Homo sapiens; identical to SEQ ID NO: 534964
  misc_feature: HIJSMM301B61FS.19.86.H09.1.454.light.4.raw

SEQ ID NO: 536784 - DNA, 509 bp, Homo sapiens
  misc_feature: HIJSMM301CQ6AB.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccca

SEQ ID NO: 536785 - DNA, 505 bp, Homo sapiens
  misc_feature: HIJSMM301CME0O.43.33.C11.1.454.light.4.raw
tgtgagtagtcacgaccggtgctcgatttagagtgagctcgttgggtttggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagattttctctcgtcatcactggtctacagtctgacgacggcgcaatgtacttctgtcaacactatgcctctccccctactaattcggttcgacgggaccggaacttaggtacaactctaactacgtaacctagtggcgtcgcacctaa

SEQ ID NO: 536786 - DNA, 494 bp, Homo sapiens; identical to SEQ ID NO: 535629
  misc_feature: HIJSMM301B9JJ9.4.27.C05.1.454.light.4.raw

SEQ ID NO: 536787 - DNA, 517 bp, Homo sapiens
  misc_feature: HIJSMM301ALBJ1.12.28.C06.1.454.light.4.raw
atacgacgtacacgaccggtgctcgatttagagctcacgtattgggtttggggagtcagtctcagtcaggacacagcatggacatgagggtccccgcccagctcctggggcgtcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtccccccggacgttcgtccgacgggaccgaccacgtaggaaatagagacgaaccgtagtggcgtgcgaccactctcgtcttctatcttcccgt

SEQ ID NO: 536788 - DNA, 466 bp, Homo sapiens
  misc_feature: HIJSMM301B7NE9.49.78.H01.1.454.light.4.raw
agtcgagagacacgaccggtgctcgatttagtgtgagtagtttgggtttggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccaatttggaaacaggggtcccatcgaggttctctggaagtggctctgggacacattttacttcaccatcagcagactgcagcctgaagatattgcaacatattactgtcaacagtatgataatctcccgctcactttcggcggaggaccaaggtggagatcaaacgaa

SEQ ID NO: 536789 - DNA, 505 bp, Homo sapiens
  misc_feature: HIJSMM301C49XP.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcgacggagggaccaaggtggacctcaaacgaactgtggctgcaccatctgtcttcatcttcccgcc

SEQ ID NO: 536790 - DNA, 489 bp, Homo sapiens; identical to SEQ ID NO: 535139
  misc_feature: HIJSMM301ASXQ9.14.55.E11.1.454.light.4.raw

SEQ ID NO: 536791 - DNA, 495 bp, Homo sapiens; identical to SEQ ID NO: 535821
  misc_feature: HIJSMM301COJB5.3.31.C09.1.454.light.4.raw

SEQ ID NO: 536792 - DNA, 505 bp, Homo sapiens
  misc_feature: HIJSMM301CV5LY.48.33.C11.1.454.light.4.raw
agtatacatacacgaccggtgctcgatttagagtgagctcgttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgcc

SEQ ID NO: 536793 - DNA, 494 bp, Homo sapiens
  misc_feature: HIJSMM301CW4ES.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagttttaccctcacaactcatatcacagaatctgaggatgctgcattttacttcggtctacaacatgataattccctcgtggacgttcggccaagggaccaaggagcaaatcaaacgaactgtggctgcaccatctgtcttcatcttccgcccat

SEQ ID NO: 536794 - DNA, 354 bp, Homo sapiens; identical to SEQ ID NO: 535026
  misc_feature: HIJSMM301EPR37.19.22.B11.1.454.light.4.raw

SEQ ID NO: 536795 - DNA, 512 bp, Homo sapiens
  misc_feature: HIJSMM301AUYX2.15.76.G10.1.454.light.4.raw
tctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcctcgctacg

SEQ ID NO: 536796 - DNA, 461 bp, Homo sapiens
  misc_feature: HIJSMM301EVGP9.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggaggggaccaggctgaccgtcctaggtcagcccaaggctgccccctcggtcactctgttcccaccctcctcacgcgtatgt

SEQ ID NO: 536797 - DNA, 515 bp, Homo sapiens
  misc_feature: HIJSMM301AG8QJ.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaacggtggagttactaacgaactagtggcgtcgcgaccactctcgttcttctactcttcccgt

SEQ ID NO: 536798 - DNA, 501 bp, Homo sapiens
  misc_feature: HIJSMM301B9JPP.26.26.C04.1.454.light.4.raw
  modified_base (498)..(498): a, c, t, g, unknown or other
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaaggaccgaaggtggaaagtacaaacgaactagtggctgnacc

SEQ ID NO: 536799 - DNA, 485 bp, Homo sapiens
  misc_feature: HIJSMM301DM7WI.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaa

SEQ ID NO: 536800 - DNA, 490 bp, Homo sapiens; identical to SEQ ID NO: 535488
  misc_feature: HIJSMM301C9HIJ.41.72.G06.1.454.light.4.raw

SEQ ID NO: 536801 - DNA, 444 bp, Homo sapiens; identical to SEQ ID NO: 535027
  misc_feature: HIJSMM301DHKEI.8.73.G07.1.454.light.4.raw

SEQ ID NO: 536802 - DNA, 496 bp, Homo sapiens
  misc_feature: HIJSMM301BV5EO.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagccc

SEQ ID NO: 536803 - DNA, 493 bp, Homo sapiens
  misc_feature: HIJSMM301CO6F7.52.52.E08.1.454.light.4.raw
cgcagtacgacacgaccggtgctcgatttagtcgagctctcagagagaaaggggtgatcaggactcctcagttccaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacacctacttgaattggtttcagcagaggccaggccaatctccaaggcgcctaatttataaggtttctcaccgggactctggggtcccagacagattcagcggcagtgggtcaggcactgatttcacgctgaaaatcagcagggtggaggctgaagatgttggggtttattactgcatgcaaggcacacactggcctgcgtacacttttggccaggggaccaagctggagaggaaacgaactgt

SEQ ID NO: 536804 - DNA, 495 bp, Homo sapiens
  misc_feature: HIJSMM301CRN7X.40.57.F02.1.454.light.4.raw
tctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctggctccagactgaggatgaggctacttattttgctgctcttatgcaggcagtttcgctctcgaagtgttcggcggagggaccgagctgaccgtcctacgtcagcccaaggctcg

SEQ ID NO: 536805 - DNA, 456 bp, Homo sapiens
  misc_feature: HIJSMM301BKUXS.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcgggtccttagggtccctaggaccgattctcgtggcgagaggtctggctcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctggtcactctgttcccgccctcctccacgagagta

SEQ ID NO: 536806 - DNA, 515 bp, Homo sapiens
  misc_feature: HIJSMM301CXEI5.43.23.C01.1.454.light.4.raw
tgtgagtagtcacgaccggtgctcgatttagtacacgtgattagggattgggggccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccacctcctcacta

SEQ ID NO: 536807 - DNA, 497 bp, Homo sapiens
  misc_feature: HIJSMM301BLDXU.10.37.D04.1.454.light.4.raw
catagtagtgcacgaccggtgctcgatttagtagcatactgttgggtttgggggctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctccgtggacgttcggccaagggaccaaggtggacctcaaacgaactgtggctgcaccat

SEQ ID NO: 536808 - DNA, 487 bp, Homo sapiens; identical to SEQ ID NO: 535583
  misc_feature: HIJSMM301C6U4D.22.73.G07.1.454.light.4.raw

SEQ ID NO: 536809 - DNA, 477 bp, Homo sapiens; identical to SEQ ID NO: 535122
  misc_feature: HIJSMM301AUFMJ.26.72.G06.1.454.light.4.raw

SEQ ID NO: 536810 - DNA, 494 bp, Homo sapiens
  misc_feature: HIJSMM301EYL1D.10.79.H02.1.454.light.4.raw
catagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtctt

SEQ ID NO: 536811 - DNA, 434 bp, Homo sapiens; identical to SEQ ID NO: 535153
  misc_feature: HIJSMM301A1PYC.18.5.A05.1.454.light.4.raw

SEQ ID NO: 536812 - DNA, 469 bp, Homo sapiens
  misc_feature: HIJSMM301BBTTV.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcacgcctgcagcctagaagattattgacaacattattactgtacaacagtatgatcgtctcctctaattcggccgtggaccagagtggacatagaaacgaa

SEQ ID NO: 536813 - DNA, 464 bp, Homo sapiens
  misc_feature: HIJSMM301DWASB.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattaactgtcaacagtatgatcgtctcctcaatttcggccctgggaccagagtggacatgaaacgaa

SEQ ID NO: 536814 - DNA, 449 bp, Homo sapiens
  misc_feature: HIJSMM301BP5BK.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgaccctcctccatactcgta

SEQ ID NO: 536815 - DNA, 444 bp, Homo sapiens; identical to SEQ ID NO: 535192
  misc_feature: HIJSMM301EEUWM.5.9.A09.1.454.light.4.raw

SEQ ID NO: 536816 - DNA, 499 bp, Homo sapiens
  misc_feature: HIJSMM301D0J2J.48.1.A01.1.454.light.4.raw
  modified_base (491)..(491): a, c, t, g, unknown or other
agtatacatacacgaccggtgctcgatttagacgtctcatcagggggcaggagtcagacccagtcaggactcagcatggacatgagggtccccgctcagctcctggggctcctgctgctctggttcccaggttccagatgcgacatccagataacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcancttccccg

SEQ ID NO: 536817 - DNA, 454 bp, Homo sapiens; identical to SEQ ID NO: 536392
  misc_feature: HIJSMM301E3E7N.19.71.G05.1.454.light.4.raw

SEQ ID NO: 536818 - DNA, 501 bp, Homo sapiens
  misc_feature: HIJSMM301AK7HT.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgaagattttgcagtgtattattgtcagcagtatggtagcgcaccgtacacttttggccaggggtccaagctggagatgaaacgaactgtggctgcaccatctgtcttcatcttccccg

SEQ ID NO: 536819 - DNA, 494 bp, Homo sapiens; identical to SEQ ID NO: 534994
  misc_feature: HIJSMM301A2SYB.27.78.H01.1.454.light.4.raw

SEQ ID NO: 536820 - DNA, 447 bp, Homo sapiens; identical to SEQ ID NO: 535201
  misc_feature: HIJSMM301C52O0.18.9.A09.1.454.light.4.raw

SEQ ID NO: 536821 - DNA, 497 bp, Homo sapiens
  misc_feature: HIJSMM301DJAKT.10.20.B09.1.454.light.4.raw
catagtagtgcacgaccggtgctcgatttagtgtagtgtgaagggggaggaactgctcagttaggacccacgacggaaccatggaagccccacgcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggtaccgaaaagtggattttcagacgaactgtggctgcaccatctgtcttca

SEQ ID NO: 536822 - DNA, 506 bp, Homo sapiens
  misc_feature: HIJSMM301CEBK7.14.7.A07.1.454.light.4.raw
cgtctagtaccacgaccggtgctcgatttagcacgtgtcgcaggggccctgaggaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgcccctcaccatcacgggggcccaggcagatgatgaatctaattatcactgtgcgttgtatatgggttttggtcatttcggtgttcggcggagggacccaggtgaccgtcctacgtcagcc

SEQ ID NO: 536823 - DNA, 434 bp, Homo sapiens; identical to SEQ ID NO: 535153
  misc_feature: HIJSMM301B4XNK.18.5.A05.1.454.light.4.raw

SEQ ID NO: 536824 - DNA, 489 bp, Homo sapiens
  misc_feature: HIJSMM301DAN3V.49.3.A03.1.454.light.4.raw
agtcgagagacacgaccggtgctcgatttagagagcgtcacagggggaggaactgctcagttaggacccagacggaaccatggaagccccagcgcagcttctcttcctcctgctactctggctcccagataccactggagaaatagtgatgacgcagtctccagccactttgtctgtgtctccaggggagagagccactctcccctgcaggaccagtcagagtgttaataacaagttagcctggtaccagcagagacctggccaggctcccaggctcctcatctatgatgtgtctaccagggccactggtatcccagccaggttcagtggcagtgggtctggggcggagttcactctcaccatcagcagcctgcagtctgaagattttgcagtttattactgtcagcactctaatgactggcccctgtacacttttggcccggggaccaaggtggagatcaaacgaactgtggctgcaccatctgtctt

SEQ ID NO: 536825 - DNA, 485 bp, Homo sapiens
  misc_feature: HIJSMM301C7876.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcgcccgtcgggaccaatgtggatatacaaacgaaactgtggctgcaccatctgtt

SEQ ID NO: 536826 - DNA, 473 bp, Homo sapiens
  misc_feature: HIJSMM301CDX4K.51.38.D05.1.454.light.4.raw
  modified_base (449)..(449): a, c, t, g, unknown or other
cgatcgtatacacgaccggtgctcgatttagtatctgatagttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggacggaacgnggtgatcaagacgactagtggcgt

SEQ ID NO: 536827 - DNA, 495 bp, Homo sapiens
  misc_feature: HIJSMM301ANYPI.48.63.F08.1.454.light.4.raw
agtatacatacacgaccggtgctcgatttagcgatcgtataagggggagtcagacccagtcaggacacagcatggacatgagggtccccgctcagctcctggggctcctgctgctctggctcccaggtgccgagtgtgacatccagatgacccagtttccttccgccctgtctgcatctgtgggagacagagtcaccatcacttgtcgggccagtcagagtgttaataagtggttggcctggtatcagcagaaacccgggaaagcccctaacctcctaatctatgaggcatctactctacaaagtggagtcccatccaggttcagcggcagtgcatctgggaccgacttcagtctcaccatcagcagcctgcaccctgatgattttgcaacttattactgtcaacaatattatacttacccgtacacttttggccaggggactaagctggagatcaaacgaactgtggctgcaccatctgtcttcatcttccccg

SEQ ID NO: 536828 - DNA, 496 bp, Homo sapiens
  misc_feature: HIJSMM301CPSMA.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactgggctcaggcggaagatgaggctgactattactgtaactcccgggccagcagtggtaacattgtgatattcggcggagggaccaaggtgaccgtcctacgtcagcccaaggctgccccctcggtcactctcg

SEQ ID NO: 536829 - DNA, 484 bp, Homo sapiens; identical to SEQ ID NO: 536393
  misc_feature: HIJSMM301AVCIG.4.41.D08.1.454.light.4.raw

SEQ ID NO: 536830 - DNA, 434 bp, Homo sapiens; identical to SEQ ID NO: 535153
  misc_feature: HIJSMM301CIY49.18.5.A05.1.454.light.4.raw

SEQ ID NO: 536831 - DNA, 470 bp, Homo sapiens; identical to SEQ ID NO: 535302
  misc_feature: HIJSMM301AIV6S.13.76.G10.1.454.light.4.raw

SEQ ID NO: 536832 - DNA, 447 bp, Homo sapiens; identical to SEQ ID NO: 535201
  misc_feature: HIJSMM301AYTCG.18.9.A09.1.454.light.4.raw

SEQ ID NO: 536833 - DNA, 526 bp, Homo sapiens
  misc_feature: HIJSMM301ALG22.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacgggaccgaacggtaggaaggtacgaaacgaacctagtggcgtgtcgaccactctgtcttctactcttcccgtccactctg

SEQ ID NO: 536834 - DNA, 503 bp, Homo sapiens
  misc_feature: HIJSMM301CGWR9.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtca

SEQ ID NO: 536835 - DNA, 417 bp, Homo sapiens
  misc_feature: HIJSMM301BFTHD.41.9.A09.1.454.light.4.raw
tctatactatcacgaccggtgctcgatttagcgagacgcgcagggcacgaccggtgctcgatttagtagcatactgttgggtttggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 536836 - DNA, 483 bp, Homo sapiens
  misc_feature: HIJSMM301B8FWI.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccgaaggtggagatcaaacgaactgtggctgcacca

SEQ ID NO: 536837 - DNA, 444 bp, Homo sapiens; identical to SEQ ID NO: 535027
  misc_feature: HIJSMM301DFFOG.8.73.G07.1.454.light.4.raw

SEQ ID NO: 536838 - DNA, 489 bp, Homo sapiens; identical to SEQ ID NO: 536663
  misc_feature: HIJSMM301DF22H.16.72.G06.1.454.light.4.raw

SEQ ID NO: 536839 - DNA, 505 bp, Homo sapiens; identical to SEQ ID NO: 535987
  misc_feature: HIJSMM301EE514.18.37.D04.1.454.light.4.raw

SEQ ID NO: 536840 - DNA, 501 bp, Homo sapiens; identical to SEQ ID NO: 535873
  misc_feature: HIJSMM301CAP7I.17.27.C05.1.454.light.4.raw

SEQ ID NO: 536841 - DNA, 447 bp, Homo sapiens; identical to SEQ ID NO: 535020
  misc_feature: HIJSMM301A13G5.18.9.A09.1.454.light.4.raw

SEQ ID NO: 536842 - DNA, 502 bp, Homo sapiens
  misc_feature: HIJSMM301DOK79.48.36.D03.1.454.light.4.raw
agtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaaccccactgtcta

SEQ ID NO: 536843 - DNA, 505 bp, Homo sapiens; identical to SEQ ID NO: 535503
  misc_feature: HIJSMM301DFNSP.8.28.C06.1.454.light.4.raw

SEQ ID NO: 536844 - DNA, 382 bp, Homo sapiens
  misc_feature: HIJSMM301ATB7T.41.28.C06.1.454.light.4.raw
tctatactatcacgaccggtgctcgatttagagctcacgtattgggtttggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 536845 - DNA, 485 bp, Homo sapiens
  misc_feature: HIJSMM301EHL75.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaaggtgcagatcaaacgaactgtggctgca

SEQ ID NO: 536846 - DNA, 454 bp, Homo sapiens
  misc_feature: HIJSMM301A2H35.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgccctcctccatactcgta

SEQ ID NO: 536847 - DNA, 516 bp, Homo sapiens
  misc_feature: HIJSMM301CD86P.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacgtccctgtgctgactcagccaccctcggtgtcagtggccccaggaaagacggccaggataacctgtgagggaaataacattggaagtaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcagtccggggtattcggcggagggaccaaggtgaccgtcctacgtcagcccaaggctcgccccctcggtcactctgttcccaccct

SEQ ID NO: 536848 - DNA, 498 bp, Homo sapiens
  misc_feature: HIJSMM301AYJKD.12.26.C04.1.454.light.4.raw
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagtttattttgtcagcaatattatcatactccgctcactttcggcggagggaccaaggtggagatcaaacgaactgtggctgcacc

SEQ ID NO: 536849 - DNA, 444 bp, Homo sapiens
  misc_feature: HIJSMM301AHMO9.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcagggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctcgccccctcggtcactctgttcccgccctcctccactactatg

SEQ ID NO: 536850 - DNA, 503 bp, Homo sapiens
  misc_feature: HIJSMM301BV46J.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcact

SEQ ID NO: 536851 - DNA, 488 bp, Homo sapiens
  misc_feature: HIJSMM301A1I20.41.2.A02.1.454.light.4.raw
tctatactatcacgaccggtgctcgatttagactcatctacagggggagtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcatggtctcccccttagtttcggcggagggaccaaggttgagatcaaacgaactgtggctgcaccatctgtcttcatt

SEQ ID NO: 536852 - DNA, 483 bp, Homo sapiens
  misc_feature: HIJSMM301DH8SE.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtgaggctgaggacgttggaatttattactgtatgcaaggtatagagcttcctccgacgttcggccaagggaccaaggtggaactcaaacgaactgtggctgcaccatctgtcttcatcttcccgccatctgactagtctacg

SEQ ID NO: 536853 - DNA, 444 bp, Homo sapiens; identical to SEQ ID NO: 535192
  misc_feature: HIJSMM301ASHVA.5.9.A09.1.454.light.4.raw

SEQ ID NO: 536854 - DNA, 383 bp, Homo sapiens; identical to SEQ ID NO: 447524
  misc_feature: HIJSMM301CDCYA.41.26.C04.1.454.light.4.raw

SEQ ID NO: 536855 - DNA, 490 bp, Homo sapiens
  misc_feature: HIJSMM301C9M4T.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtgagggaccaaggtggaggtcaaacgaactgtggctgcaccatctgtcttcatt

SEQ ID NO: 536856 - DNA, 504 bp, Homo sapiens
  misc_feature: HIJSMM301DAB5S.49.68.G02.1.454.light.4.raw
agtcgagagacacgaccggtgctcgatttagtcgatagtgaagggaaagggggaggaactgctcagttaggacccagagggaaccatggaagccccagctcagcttctcttcctcctgcttctctggctcccagatattaccggagaaattgtgttgacgcagtctccagccaccctgtctttgtctccaggggaaagagccaccctctcctgcagggccagtcagagtgttaacatctacttagtctggtaccaacagaaagctggccacgctcccaggctcctcatctatgatacatccaccagggcccctggcatcccagccaggttcagtggcagtgggtctgggacagacttcactctcaccatcagcagcttagagcctgaagattttgcagtttattactgtcagcagcgtatcaccgggatcaccttcggcccaagggaccccgactggagattaagcgaactgtggctgcaccatctgtcttcatcttcccgcca

SEQ ID NO: 536857 - DNA, 484 bp, Homo sapiens; identical to SEQ ID NO: 535400
  misc_feature: HIJSMM301BFUJO.46.26.C04.1.454.light.4.raw

SEQ ID NO: 536858 - DNA, 452 bp, Homo sapiens
  misc_feature: HIJSMM301AODT5.51.34.D01.1.454.light.4.raw
cgatcgtatacacgaccggtgctcgatttagatcgtctgtgttgggtttgggagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcggggcgaacg

SEQ ID NO: 536859 - DNA, 479 bp, Homo sapiens
  misc_feature: HIJSMM301BODSA.48.40.D07.1.454.light.4.raw
agtatacatacacgaccggtgctcgatttagtgatagagcgtaacaacagaggggctgatcaggactcctcagttcaccttctcacaatgaggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttgggttctaatcgggcctccggggtccctgacaggttcagtggccatggatcaggcacagatttcacactgaaaatcagcagagtggaggctgaggatgttggagtttactactgcatgcaagctctgcatactgctcggacgttcggtccaagggaccaacggtggag

SEQ ID NO: 536860 - DNA, 491 bp, Homo sapiens; identical to SEQ ID NO: 535294
  misc_feature: HIJSMM301AU166.16.68.G02.1.454.light.4.raw

SEQ ID NO: 536861 - DNA, 488 bp, Homo sapiens
  misc_feature: HIJSMM301CG90P.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggccaggggaccaagctggagatcaggcgaacg

SEQ ID NO: 536862 - DNA, 490 bp, Homo sapiens
  misc_feature: HIJSMM301APCYF.49.48.E04.1.454.light.4.raw
agtcgagagacacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtctt

SEQ ID NO: 536863 - DNA, 504 bp, Homo sapiens
  misc_feature: HIJSMM301BOUZ8.9.24.C02.1.454.light.4.raw
tgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggctcccaggctcctcatttatgatgcatccaacagggccactggcgtcccagccaggttcagtggcagtgggtctgggacagacttcactctcaccatcagcagcctagagcctgaagattttgcattttattactgtcagcagcgtgccaagtggcttctcactttcggcggagggaccaaggtggagaccagacgaactgtggctgcaccatctgtcttcatcttccccg

SEQ ID NO: 536864 - DNA, 489 bp, Homo sapiens; identical to SEQ ID NO: 535139
  misc_feature: HIJSMM301CL8EH.14.55.E11.1.454.light.4.raw

SEQ ID NO: 536865 - DNA, 454 bp, Homo sapiens; identical to SEQ ID NO: 534964
  misc_feature: HIJSMM301EKP35.19.86.H09.1.454.light.4.raw

SEQ ID NO: 536866 - DNA, 466 bp, Homo sapiens; identical to SEQ ID NO: 536398
  misc_feature: HIJSMM301DAM4A.3.20.B09.1.454.light.4.raw

SEQ ID NO: 536867 - DNA, 501 bp, Homo sapiens
  misc_feature: HIJSMM301CQ8NA.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctc

SEQ ID NO: 536868 - DNA, 447 bp, Homo sapiens; identical to SEQ ID NO: 535201
  misc_feature: HIJSMM301A3Z3C.18.9.A09.1.454.light.4.raw

SEQ ID NO: 536869 - DNA, 494 bp, Homo sapiens; identical to SEQ ID NO: 534992
  misc_feature: HIJSMM301A5ZUA.9.1.A01.1.454.light.4.raw

SEQ ID NO: 536870 - DNA, 483 bp, Homo sapiens
  misc_feature: HIJSMM301DNXDQ.46.26.C04.1.454.light.4.raw
  modified_base (445)..(445): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgntcactttcggcggaggaccaaggtggagatcaaacgaa

SEQ ID NO: 536871 - DNA, 501 bp, Homo sapiens
  misc_feature: HIJSMM301A247Z.48.79.H02.1.454.light.4.raw
agtatacatacacgaccggtgctcgatttagtgtcacacgaagggaaaggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggtccaagggaccaacggtggaaagtacaaacgaaactagtggctgcacca

SEQ ID NO: 536872 - DNA, 485 bp, Homo sapiens
  misc_feature: HIJSMM301DZ3D9.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccagggaccaaggtggaagtcaagcgaactgtggctgcaccatct

SEQ ID NO: 536873 - DNA, 521 bp, Homo sapiens
  misc_feature: HIJSMM301DHAV8.27.23.C01.1.454.light.4.raw
agcgtcgtctcacgaccggtgctcgatttagtacacgtgattagggattgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgtctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 536874 - DNA, 507 bp, Homo sapiens
  misc_feature: HIJSMM301ALP24.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacaccccctcactttcggcggaggggccaaggtggagatcaagcgaactgtggctgcaccatctgtcttcatcttcccgcc

SEQ ID NO: 536875 - DNA, 499 bp, Homo sapiens
  misc_feature: HIJSMM301DEVST.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctcggtcactctcg

SEQ ID NO: 536876 - DNA, 441 bp, Homo sapiens; identical to SEQ ID NO: 535074
  misc_feature: HIJSMM301EGIR9.11.3.A03.1.454.light.4.raw

SEQ ID NO: 536877 - DNA, 499 bp, Homo sapiens
  misc_feature: HIJSMM301BKM9M.51.46.E02.1.454.light.4.raw
cgatcgtatacacgaccggtgctcgatttagactcatctacagggaaaggggctgatcaggactcctcagttcaccctctcacaatgaggctccctgctcagctcctggggctgctaatgctctgggtcccaggatgcagtggggctgttgtgatgactcagtctccactctccctgcccgtcacccttggacagccggcctccatctcctgcaggtctagtcaaggcctcgtttatagtgatggagacacctacttgagttggtttcaccagaggccaggccaatctccaaggcgcctaatttataaggtttctaaccgggactctggggtcccagacaaattcagcggcagtgggtcaggcactgatttcacactgaaaatcagcagggtggaggctgaggatgttgggatttactactgtatgcaaggtacacactggcctctcactttcggcggagggaccaaggtggagatgaaacgaactgtggctgcaccat

SEQ ID NO: 536878 - DNA, 463 bp, Homo sapiens
  misc_feature: HIJSMM301AZF0Z.26.78.H01.1.454.light.4.raw
agactatactcacgaccggtgctcgatttagtgtgagtagtttgggtttggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtcttcatcttcccgccatctgaagtatagtct

SEQ ID NO: 536879 - DNA, 498 bp, Homo sapiens
  misc_feature: HIJSMM301B8H4O.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcaccta

SEQ ID NO: 536880 - DNA, 484 bp, Homo sapiens
  misc_feature: HIJSMM301CAYEQ.4.72.G06.1.454.light.4.raw
agcactgtagcacgaccggtgctcgatttagctacgactgcaagggaaaggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcggccaggacaaggtaggaagtacaacgaactagtggctgcaccat

SEQ ID NO: 536881 - DNA, 484 bp, Homo sapiens
  misc_feature: HIJSMM301AMMHM.21.25.C03.1.454.light.4.raw
tcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccagggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggtctgttcggtccggcgggacc

SEQ ID NO: 536882 - DNA, 504 bp, Homo sapiens; identical to SEQ ID NO: 535128
  misc_feature: HIJSMM301AS4BY.19.85.H08.1.454.light.4.raw

SEQ ID NO: 536883 - DNA, 519 bp, Homo sapiens
  misc_feature: HIJSMM301BVYHE.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccagctgaccgtcctaggtcagcccaaggctgccccctccggtcactctgttcccgccctcctcgagt

SEQ ID NO: 536884 - DNA, 493 bp, Homo sapiens
  misc_feature: HIJSMM301AJDQ4.40.36.D03.1.454.light.4.raw
tctagcgactcacgaccggtgctcgatttagctgcgtcacgatctctcttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccgaacgtggaaatcaaacgaactagtgg

SEQ ID NO: 536885 - DNA, 502 bp, Homo sapiens
  misc_feature: HIJSMM301AW2G9.11.21.B10.1.454.light.4.raw
cgagagataccacgaccggtgctcgatttagtgtcgtcgcaaggagagggggaggaactgctcagttaggacccacgagggaaccgatggaagccccacgctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcatcttccccg

SEQ ID NO: 536886 - DNA, 494 bp, Homo sapiens
  misc_feature: HIJSMM301BYC1R.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaacgaactgtggctgcaccatctgtcttcatt

SEQ ID NO: 536887 - DNA, 502 bp, Homo sapiens
  misc_feature: HIJSMM301C64DW.41.53.E09.1.454.light.4.raw
tctatactatcacgaccggtgctcgatttagagagagtgtgttgggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctgatcgcttctctggctccaagtctggcaatacggcctccctgacagtctctcggctccaggcggaggacgaggctgattactactgcttctcatatgcagatactaagtcctgggtgttcggcggaggaccaagctgaccgtcctaggtcagcccaaggctgccccctc

SEQ ID NO: 536888 - DNA, 463 bp, Homo sapiens; identical to SEQ ID NO: 535062
  misc_feature: HIJSMM301EUXE3.11.73.G07.1.454.light.4.raw

SEQ ID NO: 536889 - DNA, 493 bp, Homo sapiens; identical to SEQ ID NO: 535047
  misc_feature: HIJSMM301BK9WD.16.53.E09.1.454.light.4.raw

SEQ ID NO: 536890 - DNA, 495 bp, Homo sapiens
  misc_feature: HIJSMM301ARANS.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactaggagattaaacgaactgtggctgcaccatctgtt

SEQ ID NO: 536891 - DNA, 487 bp, Homo sapiens
  misc_feature: HIJSMM301CUBYA.40.83.H06.1.454.light.4.raw
tctagcgactcacgaccggtgctcgatttagatcacgtgcgtcgcggggtccaaacagagcttcggcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagcccaa

SEQ ID NO: 536892 - DNA, 416 bp, Homo sapiens
  misc_feature: HIJSMM301DEZCF.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccaccctcctcgagtagtaca

SEQ ID NO: 536893 - DNA, 492 bp, Homo sapiens
  misc_feature: HIJSMM301A2VFH.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaaggtaggagagtcaaacgaact

SEQ ID NO: 536894 - DNA, 484 bp, Homo sapiens; identical to SEQ ID NO: 535400
  misc_feature: HIJSMM301EA19L.46.26.C04.1.454.light.4.raw

SEQ ID NO: 536895 - DNA, 507 bp, Homo sapiens
  misc_feature: HIJSMM301A40KJ.2.21.B10.1.454.light.4.raw
acgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtctacgtcagcccaaggctgccccctcggtcactctcg

SEQ ID NO: 536896 - DNA, 498 bp, Homo sapiens
  misc_feature: HIJSMM301DNK8M.48.34.D01.1.454.light.4.raw
agtatacatacacgaccggtgctcgatttagatcgtctgtgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcg

SEQ ID NO: 536897 - DNA, 447 bp, Homo sapiens; identical to SEQ ID NO: 535020
  misc_feature: HIJSMM301DAG2K.18.9.A09.1.454.light.4.raw

SEQ ID NO: 536898 - DNA, 455 bp, Homo sapiens
  misc_feature: HIJSMM301AKGJH.19.86.H09.1.454.light.4.raw
tactctcgtgcacgaccggtgctcgatttagtgctatagacttgggtttgggggccgttcctgggcccagtctgtgctgactcaggcaccctcagcgtctggggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccgccctcctccacgagagta

SEQ ID NO: 536899 - DNA, 361 bp, Homo sapiens
  misc_feature: HIJSMM301EGIN9.3.57.F02.1.454.light.4.raw
agacgcactccacgaccggtgctcgatttagctcgatatagttgggtttgaggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggtcttcggcggcgggaccaagctgaccgtcctatgtcaacccaaggctggcccctcggtcactctgttcccaccctcctcagtgcgtct

SEQ ID NO: 536900 - DNA, 479 bp, Homo sapiens; identical to SEQ ID NO: 535188
  misc_feature: HIJSMM301CG13S.10.74.G08.1.454.light.4.raw

SEQ ID NO: 536901 - DNA, 492 bp, Homo sapiens
  misc_feature: HIJSMM301CH59A.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcc

SEQ ID NO: 536902 - DNA, 488 bp, Homo sapiens
  misc_feature: HIJSMM301EPE2K.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcgtcggaggacgaacgaggagatcagacgaactgtggcgtgcaccactctgtcttcta

SEQ ID NO: 536903 - DNA, 520 bp, Homo sapiens
  misc_feature: HIJSMM301CNJE6.10.71.G05.1.454.light.4.raw
  modified_base (504)..(504): a, c, t, g, unknown or other
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagaaccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgcctacttcggtcggacggaacgaaactaagaggtacgaacgaaacgtagtggcgtcgcaccactctntcttctatcttccccg

SEQ ID NO: 536904 - DNA, 444 bp, Homo sapiens; identical to SEQ ID NO: 535192
  misc_feature: HIJSMM301DH5EH.5.9.A09.1.454.light.4.raw

SEQ ID NO: 536905 - DNA, 447 bp, Homo sapiens; identical to SEQ ID NO: 535020
  misc_feature: HIJSMM301DKM7Z.18.9.A09.1.454.light.4.raw

SEQ ID NO: 536906 - DNA, 486 bp, Homo sapiens; identical to SEQ ID NO: 535523
  misc_feature: HIJSMM301A4KYB.22.73.G07.1.454.light.4.raw

SEQ ID NO: 536907 - DNA, 374 bp, Homo sapiens
  misc_feature: HIJSMM301C2AQG.49.29.C07.1.454.light.4.raw
agtcgagagacacgaccggtgctcgatttagagtgctacgaagggaaagggccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggagatcaaacgaactgtggctgcaccatctgtcttcatcttcccgccatctgatctctcgact

SEQ ID NO: 536908 - DNA, 482 bp, Homo sapiens
  misc_feature: HIJSMM301CQ2DE.48.9.A09.1.454.light.4.raw
agtatacatacacgaccggtgctcgatttagcgagacgcgcagggcacgaccggtgctcgatttagagctcacgtattgggtttggggtggtccaggaggcagaactctgggtgtctcaccatggcctggatccctctacttctcccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcgaggga

SEQ ID NO: 536909 - DNA, 490 bp, Homo sapiens
  misc_feature: HIJSMM301A7F0C.12.27.C05.1.454.light.4.raw
atacgacgtacacgaccggtgctcgatttagacgcgatcgaagggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacggccaacatcacctgctctggagataaattggggcataaatatgtctgctggtatcaacagaaggcaggccagtcccctgtggttatcatctatcaagataacaagcggccctcagggatccctgagcgattctctggctccaactctgggaacacagccactctgaccatcagcgggacccaggctatggatgaggctgactattactgtcaggcgagggacagcagtactgcggtattcggcggagggaccaagctgaccgtcctaggtcagcccaaggctgccccctcggt

SEQ ID NO: 536910 - DNA, 512 bp, Homo sapiens
  misc_feature: HIJSMM301A5K21.9.52.E08.1.454.light.4.raw
tgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaagagccaccctctcctgcagggccagtcagagtgttggtacgtccttactctggtaccaacaaaacctggccaggctcccaggctcctcatctatgatgcatccaccagggccactggcatccccgccagattcagtggcagtgggtctgggacagacttcactctcaccatcagcagcctggaccctgaagattttgcagtttattactgtcagcagcggaccaattggcccctctccctcactttcggcgggggaccgaacggtggagcgtcaaacgaactgtggctgcaccatctgtcttctatcttcccg

SEQ ID NO: 536911 - DNA, 517 bp, Homo sapiens
  misc_feature: HIJSMM301DOELL.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgactcacctccgtccgaacggaacgaccgacgtaggaggaattaaacgtaaaccgtagttggcgtcgtcacccaactcttcgtcttcctactt

SEQ ID NO: 536912 - DNA, 441 bp, Homo sapiens; identical to SEQ ID NO: 534971
  misc_feature: HIJSMM301CNN6G.11.3.A03.1.454.light.4.raw

SEQ ID NO: 536913 - DNA, 487 bp, Homo sapiens; identical to SEQ ID NO: 536206
  misc_feature: HIJSMM301ASDJN.47.38.D05.1.454.light.4.raw

SEQ ID NO: 536914 - DNA, 524 bp, Homo sapiens
  misc_feature: HIJSMM301EWTUP.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgaacggaccgaacggtaggaaggtacgaaacgaaacgtagtggcgtgcgaccactctgtcttctactcttcccgtcccactctc

SEQ ID NO: 536915 - DNA, 497 bp, Homo sapiens; identical to SEQ ID NO: 536376
  misc_feature: HIJSMM301B60ZQ.22.9.A09.1.454.light.4.raw

SEQ ID NO: 536916 - DNA, 483 bp, Homo sapiens
  misc_feature: HIJSMM301CCGRU.16.81.H04.1.454.light.4.raw
tgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctcggaccaatgtggatatcaaacgaaactgtggctgcaccatctgtctt

SEQ ID NO: 536917 - DNA, 513 bp, Homo sapiens
  misc_feature: HIJSMM301AIX5S.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaaccccactgtcactctgttcccaccct

SEQ ID NO: 536918 - DNA, 471 bp, Homo sapiens
  misc_feature: HIJSMM301EISOC.4.75.G09.1.454.light.4.raw
agcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcactgggaccaaggtcaccgtcctaggtcagcccc

SEQ ID NO: 536919 - DNA, 489 bp, Homo sapiens
  misc_feature: HIJSMM301AE10W.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccgccctcctc

SEQ ID NO: 536920 - DNA, 516 bp, Homo sapiens
  misc_feature: HIJSMM301BJAM1.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgactactacctccgtccgaacggaacggaccaccgtaggtaggaattaaacgtaaaccgtagtggcgtcgcaccaactctcgttcttctact

SEQ ID NO: 536921 - DNA, 446 bp, Homo sapiens; identical to SEQ ID NO: 536106
  misc_feature: HIJSMM301C1BLG.18.9.A09.1.454.light.4.raw

SEQ ID NO: 536922 - DNA, 484 bp, Homo sapiens
  misc_feature: HIJSMM301BM015.49.37.D04.1.454.light.4.raw
agtcgagagacacgaccggtgctcgatttagtagcatactgttgggtttgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacgaa

SEQ ID NO: 536923 - DNA, 461 bp, Homo sapiens
  misc_feature: HIJSMM301BKHSD.41.14.B03.1.454.light.4.raw
tctatactatcacgaccggtgctcgatttagtgtgagtagttccgcgggcacgaccggtgctcgatttagtgtgagtagttccgcgggcacgaccggtgctcgatttagacgcgatcgaagggtttggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactcttctccatcagcagactggagcctgaagattttgcaatttattactgtcaccagtatggtaagttcacctctaactttcggcggagggaccaaggtggagatcaaacgaactgtggctgcaccatctgtcttcatcttcccgccatctgaatagtataga

SEQ ID NO: 536924 - DNA, 502 bp, Homo sapiens
  misc_feature: HIJSMM301DO2WK.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctggaccaagtggatatcaaacgaactgtggctgcaccatctgtctt

SEQ ID NO: 536925 - DNA, 484 bp, Homo sapiens; identical to SEQ ID NO: 535240
  misc_feature: HIJSMM301AOZO0.47.60.F05.1.454.light.4.raw

SEQ ID NO: 536926 - DNA, 503 bp, Homo sapiens
  misc_feature: HIJSMM301CHTXX.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttacctcaagtgatcaccttcggccaaggacgacgactggagattaaaacg

SEQ ID NO: 536927 - DNA, 479 bp, Homo sapiens
  misc_feature: HIJSMM301DSZBQ.13.59.F04.1.454.light.4.raw
tcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacggacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtgg

SEQ ID NO: 536928 - DNA, 415 bp, Homo sapiens
  misc_feature: HIJSMM301BZF9F.18.78.H01.1.454.light.4.raw
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaagtcagcccaaggccaacccctctgtcactctgttcccgccctcctccatactcgta

SEQ ID NO: 536929 - DNA, 482 bp, Homo sapiens
  misc_feature: HIJSMM301BH312.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgaccgcgacgctcgagcgggcggtggcggaacggacgggccactaagt

SEQ ID NO: 536930 - DNA, 502 bp, Homo sapiens
  misc_feature: HIJSMM301DU1DH.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgccccctcggtcactctcg

SEQ ID NO: 536931 - DNA, 495 bp, Homo sapiens
  misc_feature: HIJSMM301BD59H.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaactgtggctgcaccatctgtcttcatt

SEQ ID NO: 536932 - DNA, 446 bp, Homo sapiens
  misc_feature: HIJSMM301D6GAR.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctggaccaaggtcaccgtcctaagtcagcccaaggccaacccctctgtcactctgttcccgccctcctccatactcgta

SEQ ID NO: 536933 - DNA, 496 bp, Homo sapiens
  misc_feature: HIJSMM301A5EDN.51.28.C06.1.454.light.4.raw
cgatcgtatacacgaccggtgctcgatttagagctcacgtattgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 536934 - DNA, 488 bp, Homo sapiens
  misc_feature: HIJSMM301AWF6U.52.83.H06.1.454.light.4.raw
  modified_base (381)..(381): a, c, t, g, unknown or other
cgcagtacgacacgaccggtgctcgatttagatcacgtgcgtcgcgggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagntattgcaacatattactgtcaacagtatggtaatctcccactcactttcggcggagggaccaaggtcgaggatcaaacgaactgtggctgcaccatctgtcttcatt

SEQ ID NO: 536935 - DNA, 532 bp, Homo sapiens
  misc_feature: HIJSMM301APOJP.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccgacggaccgaacggtaggaaggtacgaaacgaaactaagtggcgtgcgaccactctcgtcttctacttcttcccgtcccactcctcgtagt

SEQ ID NO: 536936 - DNA, 454 bp, Homo sapiens; identical to SEQ ID NO: 535005
  misc_feature: HIJSMM301DA29K.19.86.H09.1.454.light.4.raw

SEQ ID NO: 536937 - DNA, 473 bp, Homo sapiens
  misc_feature: HIJSMM301B30PC.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagccc

SEQ ID NO: 536938 - DNA, 502 bp, Homo sapiens
  misc_feature: HIJSMM301C6O0R.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaaggtggagatcaaacgaactgtggctgcaccatctgtctt

SEQ ID NO: 536939 - DNA, 512 bp, Homo sapiens
  misc_feature: HIJSMM301BWYEX.15.76.G10.1.454.light.4.raw
tctacgtagccacgaccggtgctcgatttagtcactcatacagggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcctcgctacg

SEQ ID NO: 536940 - DNA, 445 bp, Homo sapiens
  misc_feature: HIJSMM301ARJMQ.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctccggtcactctgttcccaccctcctcgacacgcgag

SEQ ID NO: 536941 - DNA, 473 bp, Homo sapiens
  misc_feature: HIJSMM301CQS52.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcggggggaccaaggtggagatcaaacgaa

SEQ ID NO: 536942 - DNA, 520 bp, Homo sapiens
  misc_feature: HIJSMM301ETATE.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgtggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccgaaggtgggacctcaaacgaaactagttggcgtgcacccaatctgtcttcctatctttcccgcccact

SEQ ID NO: 536943 - DNA, 454 bp, Homo sapiens
  misc_feature: HIJSMM301DVITJ.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccgccctcctccacgagagta

SEQ ID NO: 536944 - DNA, 447 bp, Homo sapiens
  misc_feature: HIJSMM301B2AO4.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttccgatctgggaccaaggtcaccgtcctaagtcagcccaaggccaacccctctgtcactctgttcccaccctcctccatactcgta

SEQ ID NO: 536945 - DNA, 493 bp, Homo sapiens
  misc_feature: HIJSMM301ANUJS.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctggggacagaattcactctcactatcaccagcctgcaacctgatgattttgcaacttattactgccaacagtatcatcatcattgtaatttcggtggagggaccaaggtgggaggtcaaacgaactgtggctgcaccatctgtcttcatt

SEQ ID NO: 536946 - DNA, 491 bp, Homo sapiens
  misc_feature: HIJSMM301AILHO.49.55.E11.1.454.light.4.raw
agtcgagagacacgaccggtgctcgatttagcactcgcacgttgggtttggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 536947 - DNA, 486 bp, Homo sapiens; identical to SEQ ID NO: 535054
  misc_feature: HIJSMM301C9FB2.47.70.G04.1.454.light.4.raw

SEQ ID NO: 536948 - DNA, 508 bp, Homo sapiens
  misc_feature: HIJSMM301ET1L5.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaacgtggagtatcaaacgaactgtggctgcaccatctgtctt

SEQ ID NO: 536949 - DNA, 497 bp, Homo sapiens
  misc_feature: HIJSMM301DYWJ2.19.78.H01.1.454.light.4.raw
  modified_base (463)..(463): a, c, t, g, unknown or other
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaaccccntgtcactctgttcccaccctcctccacgagagta

SEQ ID NO: 536950 - DNA, 512 bp, Homo sapiens
  misc_feature: HIJSMM301ASM3K.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctcgggaccaaaattgagatcaaacgaactgtggctgcaccactctgtcttcatcttcccgt

SEQ ID NO: 536951 - DNA, 488 bp, Homo sapiens; identical to SEQ ID NO: 535990
  misc_feature: HIJSMM301D8GI2.11.28.C06.1.454.light.4.raw

SEQ ID NO: 536952 - DNA, 415 bp, Homo sapiens; identical to SEQ ID NO: 536113
  misc_feature: HIJSMM301E0L3C.18.78.H01.1.454.light.4.raw

SEQ ID NO: 536953 - DNA, 502 bp, Homo sapiens
  misc_feature: HIJSMM301CQGS6.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcatt

SEQ ID NO: 536954 - DNA, 444 bp, Homo sapiens; identical to SEQ ID NO: 535192
  misc_feature: HIJSMM301B346Q.5.9.A09.1.454.light.4.raw

SEQ ID NO: 536955 - DNA, 506 bp, Homo sapiens
  misc_feature: HIJSMM301A18FI.48.15.B04.1.454.light.4.raw
agtatacatacacgaccggtgctcgatttagacagtatatatccgcgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccggggaccgaacgtggaaatcaaacgaactgtggctgcaccatctgtcttcat

SEQ ID NO: 536956 - DNA, 511 bp, Homo sapiens
  misc_feature: HIJSMM301BLMX0.52.67.G01.1.454.light.4.raw
cgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcggggtggaggctgaggatgttggggtttattactgcatgcaaggtacacactggcctccgacgttcggccaagggaccaaggtggaaatcaaacgaactgtggctgcaccatctgtcttcta

SEQ ID NO: 536957 - DNA, 505 bp, Homo sapiens
  misc_feature: HIJSMM301BVV69.40.4.A04.1.454.light.4.raw
tctagcgactcacgaccggtgctcgatttagagtagtgatcaggggggccgttgtcattgtgaactgagctacaacaggcaggcaggggcgagcaagatggtgttgcagacccaggtcttcatttctctgttcctctggatctctggtgccttcggggacatcgtgatgacccagtctccagactccctggctctgtctctgggcgagagggccaccatcaactgcaagtccagccagagcgttttatccacttcctacaatcagaattacttagcttggtatcagcataaaccagggcagcctccgaggctgctcatttactggacatctatccgggaatccggggtccctgaccgattccgtggcagtgggtctgggacagattttactctcaccatcaccagccttcaggctgaagatgtggcagtttattactgtcaccaatatttagacattcctccgaccgttcggccaagggaccaaggtggagatcaaacgaactgt

SEQ ID NO: 536958 - DNA, 488 bp, Homo sapiens
  misc_feature: HIJSMM301DGEN4.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggtccagggaccgaagactggagatcacaggaactgtggctgcacc

SEQ ID NO: 536959 - DNA, 480 bp, Homo sapiens
  misc_feature: HIJSMM301CNUVZ.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagatttgcagtttattactgtcagcactataataactggcctccgtactagttttggccaggggaccaagctggagatcaaacgaa

SEQ ID NO: 536960 - DNA, 477 bp, Homo sapiens
  misc_feature: HIJSMM301AO5X3.52.1.A01.1.454.light.4.raw
cgcagtacgacacgaccggtgctcgatttagacgtctcatcaggggcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcaccatctgtctt

SEQ ID NO: 536961 - DNA, 501 bp, Homo sapiens
  misc_feature: HIJSMM301CGN88.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcgccaaggacaaggtggaaatacaaacgaactagtggctgcaccactctgtcttcatcttccccg

SEQ ID NO: 536962 - DNA, 477 bp, Homo sapiens
  misc_feature: HIJSMM301BMH9L.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggaccctcagggatctcggagagattctctgcatccaggtcaggatacacagcctccctgaccattactggactccagcctgaggacgaggctgactattactgctcagcatgggacagcagcctccgtggtgtggtgatcggcggagggaccaggctgaccgtcct

SEQ ID NO: 536963 - DNA, 517 bp, Homo sapiens
  misc_feature: HIJSMM301BV43T.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttggcggagggaccgaagactgaccgtcctaggtcagcccaacggctgccccctccggtcactctgttcccgt

SEQ ID NO: 536964 - DNA, 515 bp, Homo sapiens
  misc_feature: HIJSMM301DCQP4.52.34.D01.1.454.light.4.raw
cgcagtacgacacgaccggtgctcgatttagatcgtctgtgttgggtttgggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaatttgggggttttcggcggagggaccaaggtgacgtcctacgtcagcccaaggctgccccctcggtcactctgtt

SEQ ID NO: 536965 - DNA, 486 bp, Homo sapiens
  misc_feature: HIJSMM301B2PBO.52.77.G11.1.454.light.4.raw
cgcagtacgacacgaccggtgctcgatttagctagtcactcaagggaaagggggaggtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctggggacagatttttactttcaccatcagcagcctgcagcctgaggatattgcaacatattactgtcaacagtacgataatctcccgctcacttcggtcgggggaccgaaggtggagatcaaacgaactgtggctgcacca

SEQ ID NO: 536966 - DNA, 503 bp, Homo sapiens
  misc_feature: HIJSMM301EC9WD.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcttcggccaagggaccaaggtggaaatacaaacgaactgtggctgcaccatctgtcttcatcttccccg

SEQ ID NO: 536967 - DNA, 454 bp, Homo sapiens; identical to SEQ ID NO: 534964
  misc_feature: HIJSMM301DOEZR.19.86.H09.1.454.light.4.raw

SEQ ID NO: 536968 - DNA, 447 bp, Homo sapiens; identical to SEQ ID NO: 535201
  misc_feature: HIJSMM301CN6Y8.18.9.A09.1.454.light.4.raw

SEQ ID NO: 536969 - DNA, 493 bp, Homo sapiens
  misc_feature: HIJSMM301BTD8Q.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcaagtgatcaccttcggccaagggacacgactggagattaaacgaactgtggctgcaccatctgtctt

SEQ ID NO: 536970 - DNA, 504 bp, Homo sapiens; identical to SEQ ID NO: 535709
  misc_feature: HIJSMM301DOG5F.9.55.E11.1.454.light.4.raw

SEQ ID NO: 536971 - DNA, 415 bp, Homo sapiens; identical to SEQ ID NO: 536113
  misc_feature: HIJSMM301BDJV9.18.78.H01.1.454.light.4.raw

SEQ ID NO: 536972 - DNA, 469 bp, Homo sapiens; identical to SEQ ID NO: 536091
  misc_feature: HIJSMM301D8SB5.3.82.H05.1.454.light.4.raw

SEQ ID NO: 536973 - DNA, 490 bp, Homo sapiens
  misc_feature: HIJSMM301C8ZWQ.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttgggttgttctccatgcaaggtacacactggccttttggccaggggaccaacctggagatcaaatgaactgtggctgcaccatctgtctt

SEQ ID NO: 536974 - DNA, 494 bp, Homo sapiens
  misc_feature: HIJSMM301C4STV.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaagg

SEQ ID NO: 536975 - DNA, 492 bp, Homo sapiens; identical to SEQ ID NO: 536175
  misc_feature: HIJSMM301A6ZGC.19.83.H06.1.454.light.4.raw

SEQ ID NO: 536976 - DNA, 470 bp, Homo sapiens; identical to SEQ ID NO: 536130
  misc_feature: HIJSMM301B4Q6I.7.81.H04.1.454.light.4.raw

SEQ ID NO: 536977 - DNA, 498 bp, Homo sapiens
  misc_feature: HIJSMM301BI8XG.11.75.G09.1.454.light.4.raw
cgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaa

SEQ ID NO: 536978 - DNA, 497 bp, Homo sapiens
  misc_feature: HIJSMM301BI5WN.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattctactttcggccctcgggaccgaaagtaggatttctagacgaactgtggctgcaccatctgtcttcta

SEQ ID NO: 536979 - DNA, 482 bp, Homo sapiens
  misc_feature: HIJSMM301ELR1C.16.81.H04.1.454.light.4.raw
tgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactgtggctgcaccatctgtctt

SEQ ID NO: 536980 - DNA, 517 bp, Homo sapiens
  misc_feature: HIJSMM301CRCER.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgt

SEQ ID NO: 536981 - DNA, 492 bp, Homo sapiens
  misc_feature: HIJSMM301BIPUA.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgttcggccaaggaccaaggtaggacgatcaacgaactagtggctgcaccatctgtctt

SEQ ID NO: 536982 - DNA, 509 bp, Homo sapiens
  misc_feature: HIJSMM301B6AGC.2.71.G05.1.454.light.4.raw
acgctcgacacacgaccggtgctcgatttagtgtcgtcgcaagagagagggggcgtcagaagcagagttctggggtggtctccaccatggcctggacccctcctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctataggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcactc

SEQ ID NO: 536983 - DNA, 494 bp, Homo sapiens
  misc_feature: HIJSMM301EU6RO.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccgggtccctgacaggttcagtggcagtggatcaggcacagtattttacactagaaaatcagcagagtggaggctgaggatggttggggtttattactgcatgcaagctctacaaactccttactacttttggccgaggggaccaagctggagatacaaacgaact

SEQ ID NO: 536984 - DNA, 513 bp, Homo sapiens
  misc_feature: HIJSMM301AUB6L.49.71.G05.1.454.light.4.raw
agtcgagagacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatgtgctgactcagacaccctcggtgtcggtggccccaggacagacggccttgattccctgtatgggagacgacattggaagtaagagtgtccactggtaccagcagaagccaggccaggcccctctttggtcgtctatgatgatcgcgaccggcccgcaggggtccctgaacgattctctggcgccagctctcagaacacggccaccctgatcatcaacagggtcgaagtcggggatgaggccgactattactgtcaggtctgggatactgaaattgaatatgtcttcggaactgggaccaaagtcaccgtcctaggtcagcccaaggccaaccccactgtcactctgttcccaccctcct

SEQ ID NO: 536985 - DNA, 488 bp, Homo sapiens
  misc_feature: HIJSMM301CUUG9.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcagggaccaagttgaacatcaatcgaactgtggctgcacc

SEQ ID NO: 536986 - DNA, 487 bp, Homo sapiens
  misc_feature: HIJSMM301EDJFA.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgctagtttattactgtcagcattacaataactggcctcggctcactttcggcggagggaccaaggtggagatcaaacgaactgtggctgcaccat

SEQ ID NO: 536987 - DNA, 494 bp, Homo sapiens; identical to SEQ ID NO: 535828
  misc_feature: HIJSMM301CBYM5.3.36.D03.1.454.light.4.raw

SEQ ID NO: 536988 - DNA, 491 bp, Homo sapiens
  misc_feature: HIJSMM301BACLD.17.21.B10.1.454.light.4.raw
cgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtggctgca

SEQ ID NO: 536989 - DNA, 471 bp, Homo sapiens
  misc_feature: HIJSMM301BW08C.5.73.G07.1.454.light.4.raw
atcagacacgcacgaccggtgctcgatttagctctacgctcagggcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttc

SEQ ID NO: 536990 - DNA, 521 bp, Homo sapiens
  misc_feature: HIJSMM301A8MIA.27.23.C01.1.454.light.4.raw
  modified_base (517)..(517): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccnccct

SEQ ID NO: 536991 - DNA, 515 bp, Homo sapiens
  misc_feature: HIJSMM301BNCKV.13.55.E11.1.454.light.4.raw
tcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataataaccggccctctgggatccctgaccgattctctggctccaactcggggaacacggccaccctgaccatcaacagagcccaagacggggatgaggctgactattattgtcaggtgtgggacagcaccacggtgatattcggcggcgggaccaagctgaccgtcctaggtcagcccaaggctgccccctcggtcactctgttcccaccctctct

SEQ ID NO: 536992 - DNA, 517 bp, Homo sapiens
  misc_feature: HIJSMM301A0Y62.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccacctcctcacg

SEQ ID NO: 536993 - DNA, 440 bp, Homo sapiens
  misc_feature: HIJSMM301BHHHX.48.7.A07.1.454.light.4.raw
agtatacatacacgaccggtgctcgatttagcacgtgtcgcagggtcctgggcccagtctgtggtgactcagccaccctcagcgtctgggacccccggacagagagtcaccatctcctgttctggaagcagcgccaacattggacgtaatactgtcaactggtaccaacaactcgcaggaacggccccaaactcctcatctatgaccatcataagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcagcccaaggctgccccctcggtcactctgttcccaccctcctctatgtatact

SEQ ID NO: 536994 - DNA, 434 bp, Homo sapiens; identical to SEQ ID NO: 536762
  misc_feature: HIJSMM301CLXJK.48.1.A01.1.454.light.4.raw

SEQ ID NO: 536995 - DNA, 508 bp, Homo sapiens
  misc_feature: HIJSMM301DI7LX.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagatttgcaacttactactgtcaacagagttacagtaccccctcctctacgttcggacggacggaacgaggcggagtacacgaagaacgtaacgtggtcggtcgcgaccaacctatcgttcgttctt

SEQ ID NO: 536996 - DNA, 507 bp, Homo sapiens
  misc_feature: HIJSMM301CQ1WU.49.11.A11.1.454.light.4.raw
agtcgagagacacgaccggtgctcgatttagctacgactgcagggagaagggctggatgacttgggatggggagagagacccctcccctgggatcctgcagctccaggctcccgtgggtggggttagagtctgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccggtcgaagacggggatgaggccgactattactgtcaggtgtgggatagtggtagtggt

SEQ ID NO: 536997 - DNA, 483 bp, Homo sapiens
  misc_feature: HIJSMM301EXRP4.46.35.D02.1.454.light.4.raw
actagcagtacacgaccggtgctcgatttagcacacgatagttgggtttggggagctgctcagttaggacccagagggaaccatggaaaccccacgcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaactttggccaggggaccaagctggagatcaagacgactgtggctgcacc

SEQ ID NO: 536998 - DNA, 492 bp, Homo sapiens
  misc_feature: HIJSMM301DZII6.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactagtggctgcaccatctgtcttcatt

SEQ ID NO: 536999 - DNA, 444 bp, Homo sapiens; identical to SEQ ID NO: 535856
  misc_feature: HIJSMM301DE388.9.9.A09.1.454.light.4.raw

SEQ ID NO: 537000 - DNA, 508 bp, Homo sapiens
  misc_feature: HIJSMM301ADR2T.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggtccgaagggaaccgaaaggtaggaaatacaaacgaaacctagttggctgcaccaatctgtcttctatcttcccgtcccact

SEQ ID NO: 537001 - DNA, 479 bp, Homo sapiens; identical to SEQ ID NO: 535118
  misc_feature: HIJSMM301DOJJM.13.59.F04.1.454.light.4.raw

SEQ ID NO: 537002 - DNA, 502 bp, Homo sapiens
  misc_feature: HIJSMM301EUN6H.19.67.G01.1.454.light.4.raw
tactctcgtgcacgaccggtgctcgatttagagtatacatattgggtttggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttctatcctccgtggacgttcggccaagggaccagggtggaaatcagacgaactgtggctgcaccat

SEQ ID NO: 537003 - DNA, 494 bp, Homo sapiens
  misc_feature: HIJSMM301C9OLB.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagatttgcagtgtattattgtcagcaatatggtaggtcacctgggacttttggccaggggaccaagctggagatcaaacgaactgtggctgcaccatctgtctt

SEQ ID NO: 537004 - DNA, 447 bp, Homo sapiens; identical to SEQ ID NO: 535201
  misc_feature: HIJSMM301AYWRY.18.9.A09.1.454.light.4.raw

SEQ ID NO: 537005 - DNA, 494 bp, Homo sapiens; identical to SEQ ID NO: 534994
  misc_feature: HIJSMM301CDII9.27.78.H01.1.454.light.4.raw

SEQ ID NO: 537006 - DNA, 502 bp, Homo sapiens
  misc_feature: HIJSMM301DUJC4.49.30.C08.1.454.light.4.raw
agtcgagagacacgaccggtgctcgatttagtctgacgtcaaagggaaaggggatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagactttcggccaagggaccaaggtggaaatcaaacgaactgtggctgcaccatctgtcttcatcttcccgccat

SEQ ID NO: 537007 - DNA, 482 bp, Homo sapiens
  misc_feature: HIJSMM301CF1DU.41.34.D01.1.454.light.4.raw
tctatactatcacgaccggtgctcgatttagatcgtctgtgttgggtttggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcacca

SEQ ID NO: 537008 - DNA, 444 bp, Homo sapiens; identical to SEQ ID NO: 535027
  misc_feature: HIJSMM301B3GVR.8.73.G07.1.454.light.4.raw

SEQ ID NO: 537009 - DNA, 487 bp, Homo sapiens
  misc_feature: HIJSMM301C1OHN.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggccaggggaccaagctggagatcaggcgaacg

SEQ ID NO: 537010 - DNA, 492 bp, Homo sapiens
  misc_feature: HIJSMM301CC2UK.7.76.G10.1.454.light.4.raw
  modified_base (460)..(460): a, c, t, g, unknown or other
cgtgtctctacacgaccggtgctcgatttagtcactcatacagggggcgaggagtcagacccacgtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcgggcgggggaccggaacgtaggngatacaacgaaactgtggcgtcgcaccaactt

SEQ ID NO: 537011 - DNA, 486 bp, Homo sapiens; identical to SEQ ID NO: 535043
  misc_feature: HIJSMM301DFDLI.46.35.D02.1.454.light.4.raw

SEQ ID NO: 537012 - DNA, 485 bp, Homo sapiens; identical to SEQ ID NO: 535985
  misc_feature: HIJSMM301ATZ7Q.15.1.A01.1.454.light.4.raw

SEQ ID NO: 537013 - DNA, 484 bp, Homo sapiens
  misc_feature: HIJSMM301EVU5J.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaactttattactgtacaaaaagtataaacagtcgccccctttcaccctttcggcccaagggacacgactggagattagaacg

SEQ ID NO: 537014 - DNA, 488 bp, Homo sapiens; identical to SEQ ID NO: 535990
  misc_feature: HIJSMM301CHO72.11.28.C06.1.454.light.4.raw

SEQ ID NO: 537015 - DNA, 492 bp, Homo sapiens
  misc_feature: HIJSMM301BL8V1.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccagggtggagatcaaacgaactgtggctgcaccatctgtcttca

SEQ ID NO: 537016 - DNA, 497 bp, Homo sapiens; identical to SEQ ID NO: 535740
  misc_feature: HIJSMM301DK7XQ.3.71.G05.1.454.light.4.raw

SEQ ID NO: 537017 - DNA, 447 bp, Homo sapiens; identical to SEQ ID NO: 535020
  misc_feature: HIJSMM301BNDWF.18.9.A09.1.454.light.4.raw

SEQ ID NO: 537018 - DNA, 446 bp, Homo sapiens
  misc_feature: HIJSMM301AO333.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtcccgtgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctccggtcactctgttcccaccctcctccgtgtctgat

SEQ ID NO: 537019 - DNA, 485 bp, Homo sapiens; identical to SEQ ID NO: 536263
  misc_feature: HIJSMM301AQF7U.47.78.H01.1.454.light.4.raw

SEQ ID NO: 537020 - DNA, 498 bp, Homo sapiens
  misc_feature: HIJSMM301C0P2C.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatcaaacgaactgtggctgcacc

SEQ ID NO: 537021 - DNA, 446 bp, Homo sapiens
  misc_feature: HIJSMM301BXOX9.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggcaacccctctgtcactctgttcccaccctcctccatactcgta

SEQ ID NO: 537022 - DNA, 493 bp, Homo sapiens; identical to SEQ ID NO: 535745
  misc_feature: HIJSMM301D3NOY.47.78.H01.1.454.light.4.raw

SEQ ID NO: 537023 - DNA, 509 bp, Homo sapiens; identical to SEQ ID NO: 536047
  misc_feature: HIJSMM301ASN70.17.33.C11.1.454.light.4.raw

SEQ ID NO: 537024 - DNA, 486 bp, Homo sapiens
  misc_feature: HIJSMM301A2T53.47.70.G04.1.454.light.4.raw
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagattttcactctcaccatcagcagtctgcaacctgaagattttgcaacttactactgtcaacagagttacggtacccgtacacttttggccaggggaccaaactggacatcaaacgaactgtggctgcaccatctgt

SEQ ID NO: 537025 - DNA, 494 bp, Homo sapiens; identical to SEQ ID NO: 534992
  misc_feature: HIJSMM301CWR0P.9.1.A01.1.454.light.4.raw

SEQ ID NO: 537026 - DNA, 492 bp, Homo sapiens
  misc_feature: HIJSMM301BWVG5.53.22.B11.1.454.light.4.raw
cgcgtatacacacgaccggtgctcgatttagacgacagctcagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactctcg

SEQ ID NO: 537027 - DNA, 484 bp, Homo sapiens; identical to SEQ ID NO: 535400
  misc_feature: HIJSMM301A3YRQ.46.26.C04.1.454.light.4.raw

SEQ ID NO: 537028 - DNA, 379 bp, Homo sapiens
  misc_feature: HIJSMM301CKKCC.12.78.H01.1.454.light.4.raw
atacgacgtacacgaccggtgctcgatttagtgtgagtagtttgggtttggggccgttcctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccaccctcctctacgtcgtat

SEQ ID NO: 537029 - DNA, 494 bp, Homo sapiens; identical to SEQ ID NO: 534992
  misc_feature: HIJSMM301CLI3T.9.1.A01.1.454.light.4.raw

SEQ ID NO: 537030 - DNA, 416 bp, Homo sapiens; identical to SEQ ID NO: 535308
  misc_feature: HIJSMM301BVTL3.16.46.E02.1.454.light.4.raw

SEQ ID NO: 537031 - DNA, 373 bp, Homo sapiens
  misc_feature: HIJSMM301CG74V.11.60.F05.1.454.light.4.raw
cgagagataccacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgagtatctctcg

SEQ ID NO: 537032 - DNA, 485 bp, Homo sapiens
  misc_feature: HIJSMM301B6U2K.12.88.H11.1.454.light.4.raw
atacgacgtacacgaccggtgctcgatttagcgacagcgagaacacacaaagggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccggtggggctgaggatgttggcatttattactgcatgcaggctatacaccttcctgccacttttggccaggggaccaagctggagatcaggcgaacg

SEQ ID NO: 537033 - DNA, 457 bp, Homo sapiens
  misc_feature: HIJSMM301D7KO8.49.85.H08.1.454.light.4.raw
agtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagtcgcactggggtattcggcggagggaccaagctgaccgt

SEQ ID NO: 537034 - DNA, 474 bp, Homo sapiens
  misc_feature: HIJSMM301CPSOH.5.15.B04.1.454.light.4.raw
atcagacacgcacgaccggtgctcgatttagacagtatatatccgcgggggtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggccaagggaccaaggtggaaatcaaacgaactgtggctgcacc

SEQ ID NO: 537035 - DNA, 516 bp, Homo sapiens
  misc_feature: HIJSMM301D0Z4V.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggccgaacgggaccgaacggtaggaagtacaaacgaaactacgtggctgcaccatctgtcttctatcttcccgccact

SEQ ID NO: 537036 - DNA, 516 bp, Homo sapiens
  misc_feature: HIJSMM301BAETR.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggctgccccctcggtcactctgttcccacctcctccacg

SEQ ID NO: 537037 - DNA, 497 bp, Homo sapiens
  misc_feature: HIJSMM301BIIXO.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccgaaggtggatatcagacgaactgtggctg

SEQ ID NO: 537038 - DNA, 508 bp, Homo sapiens
  misc_feature: HIJSMM301DTQS4.4.57.F02.1.454.light.4.raw
agcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctgttccta

SEQ ID NO: 537039 - DNA, 518 bp, Homo sapiens
  misc_feature: HIJSMM301AVS7G.49.10.A10.1.454.light.4.raw
agtcgagagacacgaccggtgctcgatttagcgtcgatctcaggggctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcg

SEQ ID NO: 537040 - DNA, 485 bp, Homo sapiens; identical to SEQ ID NO: 536075
  misc_feature: HIJSMM301BIVG6.17.21.B10.1.454.light.4.raw

SEQ ID NO: 537041 - DNA, 444 bp, Homo sapiens; identical to SEQ ID NO: 535192
  misc_feature: HIJSMM301DVPK0.5.9.A09.1.454.light.4.raw

SEQ ID NO: 537042 - DNA, 492 bp, Homo sapiens
  misc_feature: HIJSMM301AY808.48.73.G07.1.454.light.4.raw
agtatacatacacgaccggtgctcgatttagctctacgctcagggcacgaccggtgctcgatttagtgacatctcgcagttctttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacga

SEQ ID NO: 537043 - DNA, 473 bp, Homo sapiens; identical to SEQ ID NO: 535262
  misc_feature: HIJSMM301DOCAP.8.67.G01.1.454.light.4.raw

SEQ ID NO: 537044 - DNA, 486 bp, Homo sapiens; identical to SEQ ID NO: 536261
  misc_feature: HIJSMM301CXZ1F.26.55.E11.1.454.light.4.raw

SEQ ID NO: 537045 - DNA, 485 bp, Homo sapiens
  misc_feature: HIJSMM301DHB9F.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatctgt

SEQ ID NO: 537046 - DNA, 510 bp, Homo sapiens
  misc_feature: HIJSMM301AXJD6.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagtatttgcagtgtattactgtcagcagtagtggtagctcaccgtcggacgttcggaccgaacggaaccgaacggtaggtaaagtacaaacgaacgtaggtggtcgtcgcaccactctcgtt

SEQ ID NO: 537047 - DNA, 511 bp, Homo sapiens
  misc_feature: HIJSMM301DNFHC.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgtgtctgat

SEQ ID NO: 537048 - DNA, 493 bp, Homo sapiens
  misc_feature: HIJSMM301CW8C4.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtctaggtcagcccaaggctgccccctcggtcactctgttcccaccctcctcacgcg

SEQ ID NO: 537049 - DNA, 496 bp, Homo sapiens; identical to SEQ ID NO: 535109
  misc_feature: HIJSMM301ERNVE.16.78.H01.1.454.light.4.raw

SEQ ID NO: 537050 - DNA, 518 bp, Homo sapiens
  misc_feature: HIJSMM301DAWBD.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactgggcaccccagacaggatcagtggcagcgggtctgggacagacttcattctcaccatcaacagactgcagcctgaagatattgcagtttactactgtcagcagtatgttacgtccccgtggacgttcggccaaggaccaaggtggcaatcaaccgaactgtggctgcaccatctgtcttcatcttccccg

SEQ ID NO: 537051 - DNA, 491 bp, Homo sapiens
  misc_feature: HIJSMM301B32YC.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatcccagatgacccagtcgtccatcctcccgtgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttca

SEQ ID NO: 537052 - DNA, 494 bp, Homo sapiens
  misc_feature: HIJSMM301AKE6T.10.79.H02.1.454.light.4.raw
catagtagtgcacgaccggtgctcgatttagtgtcacacgaagggaaaggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtcttcta

SEQ ID NO: 537053 - DNA, 502 bp, Homo sapiens
  misc_feature: HIJSMM301AL099.43.58.F03.1.454.light.4.raw
tgtgagtagtcacgaccggtgctcgatttagtctgatcgagaagggaaaggggagctacaacaggcaggcaggggcgagcaagatggtgttgcagacccaggtcttcatttcttctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcgccaaggaccgaaggtaggaagtacagacgaactgtggctgcacca

SEQ ID NO: 537054 - DNA, 478 bp, Homo sapiens; identical to SEQ ID NO: 535129
  misc_feature: HIJSMM301CVIEV.11.11.A11.1.454.light.4.raw

SEQ ID NO: 537055 - DNA, 488 bp, Homo sapiens
  misc_feature: HIJSMM301DFD23.4.64.F09.1.454.light.4.raw
agcactgtagcacgaccggtgctcgatttagcgcgtatacaagggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgcaacttacttttgtcaacagactaactcattccctcgcagttttggccaggggaccaaggtggagatcaaacgaactgtggctgcaccatctgtcttcatt

SEQ ID NO: 537056 - DNA, 464 bp, Homo sapiens
  misc_feature: HIJSMM301BJFZN.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagatagcgctgccccgctcagtttcggcggagggaccaaggtggagatac

SEQ ID NO: 537057 - DNA, 494 bp, Homo sapiens; identical to SEQ ID NO: 534992
  misc_feature: HIJSMM301B09PG.9.1.A01.1.454.light.4.raw

SEQ ID NO: 537058 - DNA, 493 bp, Homo sapiens; identical to SEQ ID NO: 536246
  misc_feature: HIJSMM301CJJTL.49.66.F11.1.454.light.4.raw

SEQ ID NO: 537059 - DNA, 488 bp, Homo sapiens
  misc_feature: HIJSMM301A1TMM.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttgggggtttattactgcatgcaagttctacaaacttcctacacttttggccaggggaccaagctggagatcaaacgaa

SEQ ID NO: 537060 - DNA, 466 bp, Homo sapiens; identical to SEQ ID NO: 535366
  misc_feature: HIJSMM301DKB00.13.4.A04.1.454.light.4.raw

SEQ ID NO: 537061 - DNA, 494 bp, Homo sapiens; identical to SEQ ID NO: 534994
  misc_feature: HIJSMM301DM066.27.78.H01.1.454.light.4.raw

SEQ ID NO: 537062 - DNA, 485 bp, Homo sapiens; identical to SEQ ID NO: 535018
  misc_feature: HIJSMM301A3XBZ.46.35.D02.1.454.light.4.raw

SEQ ID NO: 537063 - DNA, 486 bp, Homo sapiens; identical to SEQ ID NO: 535043
  misc_feature: HIJSMM301ED2AF.46.35.D02.1.454.light.4.raw

SEQ ID NO: 537064 - DNA, 509 bp, Homo sapiens
  misc_feature: HIJSMM301AEAK0.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggtcggagggaccgaaggtggagatcaaacgaactagtggctgcaccatctgtt

SEQ ID NO: 537065 - DNA, 519 bp, Homo sapiens
  misc_feature: HIJSMM301BILDD.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctggttcggcggagggaccaagctgaccgtctaggtcagcccaaggctcgccccctcggtcactctgttcccaccctcctcacg

SEQ ID NO: 537066 - DNA, 446 bp, Homo sapiens
  misc_feature: HIJSMM301BQM3W.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctctccatactcgta

SEQ ID NO: 537067 - DNA, 488 bp, Homo sapiens
  misc_feature: HIJSMM301AT166.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggtcggagggaccaaggtggagatcaaacgaactgt

SEQ ID NO: 537068 - DNA, 521 bp, Homo sapiens
  misc_feature: HIJSMM301CCELC.27.23.C01.1.454.light.4.raw
agcgtcgtctcacgaccggtgctcgatttagtacacgtgattagggattgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 537069 - DNA, 494 bp, Homo sapiens; identical to SEQ ID NO: 535276
  misc_feature: HIJSMM301AMF77.16.6.A06.1.454.light.4.raw

SEQ ID NO: 537070 - DNA, 444 bp, Homo sapiens; identical to SEQ ID NO: 535042
  misc_feature: HIJSMM301AJF3D.10.76.G10.1.454.light.4.raw

SEQ ID NO: 537071 - DNA, 457 bp, Homo sapiens; identical to SEQ ID NO: 536586
  misc_feature: HIJSMM301D368M.49.85.H08.1.454.light.4.raw

SEQ ID NO: 537072 - DNA, 440 bp, Homo sapiens
  misc_feature: HIJSMM301BWRHL.41.9.A09.1.454.light.4.raw
tctatactatcacgaccggtgctcgatttagcgagacgcgcagggtcctgggcccagtctgtcctgactcagccaccctcagcgtctgggacccccggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccaccctcctcatagtataga

SEQ ID NO: 537073 - DNA, 484 bp, Homo sapiens
  misc_feature: HIJSMM301BCCLC.4.57.F02.1.454.light.4.raw
agcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcggcggaggaccaaggtggagatcaaacgaactgtggctgcacc

SEQ ID NO: 537074 - DNA, 416 bp, Homo sapiens; identical to SEQ ID NO: 536892
  misc_feature: HIJSMM301DJD9H.16.46.E02.1.454.light.4.raw

SEQ ID NO: 537075 - DNA, 445 bp, Homo sapiens
  misc_feature: HIJSMM301A65DW.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtcccgtgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccaccctcctccgtgtctgat

SEQ ID NO: 537076 - DNA, 512 bp, Homo sapiens
  misc_feature: HIJSMM301AIO3M.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccgggggaccgaaagtggaaatcaaacgaactgtggctgcaccatctgtcttcatcttcccgccact

SEQ ID NO: 537077 - DNA, 441 bp, Homo sapiens; identical to SEQ ID NO: 534971
  misc_feature: HIJSMM301CSN79.11.3.A03.1.454.light.4.raw

SEQ ID NO: 537078 - DNA, 421 bp, Homo sapiens
  misc_feature: HIJSMM301CJO8N.9.34.D01.1.454.light.4.raw
tgatacgtctcacgaccggtgctcgatttagatcgtctgtgttgggtttggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccgccctcctcagacgtatca

SEQ ID NO: 537079 - DNA, 487 bp, Homo sapiens
  misc_feature: HIJSMM301A50RY.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttc

SEQ ID NO: 537080 - DNA, 481 bp, Homo sapiens
  misc_feature: HIJSMM301DOTU3.3.38.D05.1.454.light.4.raw
  modified_base (457)..(457): a, c, t, g, unknown or other
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccgaagtggngatcaacgaactgtggctgcacca

SEQ ID NO: 537081 - DNA, 517 bp, Homo sapiens
  misc_feature: HIJSMM301AUWSV.49.78.H01.1.454.light.4.raw
agtcgagagacacgaccggtgctcgatttagtgtgagtagtttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacaacttgggtgttcggcggcgggaccgaaactgaccgtcctacgtcagcccaaggctgccccctcgtcactctgtt

SEQ ID NO: 537082 - DNA, 454 bp, Homo sapiens; identical to SEQ ID NO: 536347
  misc_feature: HIJSMM301BL8LS.19.86.H09.1.454.light.4.raw

SEQ ID NO: 537083 - DNA, 473 bp, Homo sapiens
  misc_feature: HIJSMM301EBSEQ.13.76.G10.1.454.light.4.raw
  modified_base (428)..(428): a, c, t, g, unknown or other
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgntatgtcttcggaactgggaccaggtcaccgtctaagtcagacccg

SEQ ID NO: 537084 - DNA, 472 bp, Homo sapiens
  misc_feature: HIJSMM301ELI6Z.53.83.H06.1.454.light.4.raw
cgcgtatacacacgaccggtgctcgatttagatcacgtgcgtcgcgggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagcgaccatcacctgttctggagacaaattgactgataaatatgctggctggtatcggcagaagccaggccagtcgcctgtgttggtcatctatcaggatagcaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgtcctgagtcagaccccg

SEQ ID NO: 537085 - DNA, 478 bp, Homo sapiens
  misc_feature: HIJSMM301AKRUC.48.5.A05.1.454.light.4.raw
agtatacatacacgaccggtgctcgatttagatagatagacaggggggaggtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcgccaaggaccaaggtggaatacaaacgaactagtggctgcaccat

SEQ ID NO: 537086 - DNA, 484 bp, Homo sapiens
  misc_feature: HIJSMM301DCEFO.5.39.D06.1.454.light.4.raw
atcagacacgcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaactgtggctgcaccatctgtctt

SEQ ID NO: 537087 - DNA, 494 bp, Homo sapiens; identical to SEQ ID NO: 534994
  misc_feature: HIJSMM301CTP9Z.27.78.H01.1.454.light.4.raw

SEQ ID NO: 537088 - DNA, 506 bp, Homo sapiens; identical to SEQ ID NO: 535404
  misc_feature: HIJSMM301DK2T3.10.88.H11.1.454.light.4.raw

SEQ ID NO: 537089 - DNA, 352 bp, Homo sapiens; identical to SEQ ID NO: 535995
  misc_feature: HIJSMM301A0KZ3.4.67.G01.1.454.light.4.raw

SEQ ID NO: 537090 - DNA, 488 bp, Homo sapiens
  misc_feature: HIJSMM301C0KYW.47.48.E04.1.454.light.4.raw
agctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaagggaccgaacggtggaaagtacaaacgaactagtggctgcacca

SEQ ID NO: 537091 - DNA, 494 bp, Homo sapiens
  misc_feature: HIJSMM301B09JF.27.78.H01.1.454.light.4.raw
  modified_base (426)..(426): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttaccncaagtgatcaccttcggccaagggacacgactggagattaaacgaactgtggctgcaccatctgtctt

SEQ ID NO: 537092 - DNA, 510 bp, Homo sapiens
  misc_feature: HIJSMM301BRMDQ.40.33.C11.1.454.light.4.raw
tctagcgactcacgaccggtgctcgatttagagtgagctcgttgggtttgggggaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggagggaccaagctgaccgtccg

SEQ ID NO: 537093 - DNA, 454 bp, Homo sapiens
  misc_feature: HIJSMM301AWTA5.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctccggtcactctgttcccgccctcctccacgagagta

SEQ ID NO: 537094 - DNA, 511 bp, Homo sapiens
  misc_feature: HIJSMM301B4ZSJ.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgtccacgggaccgacacgtagaaatagtaggacgaaacctgtggcgtcgcaccatctgtcttcatcttcccgt

SEQ ID NO: 537095 - DNA, 491 bp, Homo sapiens
  misc_feature: HIJSMM301D6LBZ.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaacgaactgtggctgcacatctgtcttc

SEQ ID NO: 537096 - DNA, 510 bp, Homo sapiens
  misc_feature: HIJSMM301EIVSM.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgttgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctcgaggttcagtggcagtggatctgggacacatttcaccctcaccatcaatagcctggaagctgaagatgctgcaacttattactgtcatcagagtactacttactcaagtgatcaccttcggccaagggacacgacgtggaagattaaacgtaacg

SEQ ID NO: 537097 - DNA, 438 bp, Homo sapiens
  misc_feature: HIJSMM301BRDZP.51.37.D04.1.454.light.4.raw
cgatcgtatacacgaccggtgctcgatttagtagcatactgttgggtttgggtagtttgggtttggggctttccccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtacccctcagctcactttcggcggagggaccaaggtggagatcaaacgaactgtggctgcaccatctgtcttcatcttcccgccatctgatcgtagcact

SEQ ID NO: 537098 - DNA, 498 bp, Homo sapiens
  misc_feature: HIJSMM301AU4M6.12.67.G01.1.454.light.4.raw
atacgacgtacacgaccggtgctcgatttagagtatacatattgggttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtgggaccaaggtcaccgtcctacgtcagcccaaggccaaccca

SEQ ID NO: 537099 - DNA, 492 bp, Homo sapiens
  misc_feature: HIJSMM301ALKV8.49.46.E02.1.454.light.4.raw
agtcgagagacacgaccggtgctcgatttagactcatctacagggaaagggggaggaactgctcagttaggacccagagggaaccatggaagccccagctcagcttctcttcctcctgctactctggctcccagataccaccggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggagatcaaacgaactgtggctgcaccatctgt

SEQ ID NO: 537100 - DNA, 488 bp, Homo sapiens; identical to SEQ ID NO: 535990
  misc_feature: HIJSMM301ESX79.11.28.C06.1.454.light.4.raw

SEQ ID NO: 537101 - DNA, 497 bp, Homo sapiens
  misc_feature: HIJSMM301C7OKK.41.11.A11.1.454.light.4.raw
tctatactatcacgaccggtgctcgatttagctacgactgcagggggaggaactgctcagttaggacccagacggaaccatggaagccccagcgcagcttctcttcctcctgctactctggctcccagataccactggagaaatagtggtgacgcagtctccagccaccctgtctgtgtctccaggggaaggagccaccctctcctgcagggccagtcagagtattagcagcagcttagcctggtaccagcagaagcctggccaggctcccaggctcctcgtctatggtgcatccaccagggccactggtatcccagccaggttcagtggcagtgggtctgggacagagttcactctcaccatcaccagcctgcagtctgaagattttggagttttatttctgtcaccagtataaggactggccttcgggtaacttttggccgaggggaccgaagcgtggagatcagacgaactgtggctgcaccatctgtcttcta

SEQ ID NO: 537102 - DNA, 485 bp, Homo sapiens; identical to SEQ ID NO: 535985
  misc_feature: HIJSMM301DMXWT.15.1.A01.1.454.light.4.raw

SEQ ID NO: 537103 - DNA, 503 bp, Homo sapiens
  misc_feature: HIJSMM301DCYMN.40.67.G01.1.454.light.4.raw
tctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgc

SEQ ID NO: 537104 - DNA, 506 bp, Homo sapiens
  misc_feature: HIJSMM301AR1NQ.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggtccaagggaccaaggtggaaagtacaaacgaaactagtggctgcaccatctgtcttctatctttccccg

SEQ ID NO: 537105 - DNA, 445 bp, Homo sapiens
  misc_feature: HIJSMM301C8BSZ.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcagggtcgtctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgcccctcctccactactatg

SEQ ID NO: 537106 - DNA, 454 bp, Homo sapiens; identical to SEQ ID NO: 534964
  misc_feature: HIJSMM301AT2N4.19.86.H09.1.454.light.4.raw

SEQ ID NO: 537107 - DNA, 460 bp, Homo sapiens
  misc_feature: HIJSMM301DZ26W.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccgccctcctcacgcgtatgt

SEQ ID NO: 537108 - DNA, 475 bp, Homo sapiens
  misc_feature: HIJSMM301DZJHN.7.12.B01.1.454.light.4.raw
cgtgtctctacacgaccggtgctcgatttagtagtgtagattcacgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctggactgaagtgcatatgaagagaactgtggctgca

SEQ ID NO: 537109 - DNA, 493 bp, Homo sapiens; identical to SEQ ID NO: 535047
  misc_feature: HIJSMM301CL2DT.16.53.E09.1.454.light.4.raw

SEQ ID NO: 537110 - DNA, 490 bp, Homo sapiens; identical to SEQ ID NO: 535234
  misc_feature: HIJSMM301AEVFC.17.21.B10.1.454.light.4.raw

SEQ ID NO: 537111 - DNA, 464 bp, Homo sapiens
  misc_feature: HIJSMM301D91DQ.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccaccctcctcctagtctacg

SEQ ID NO: 537112 - DNA, 447 bp, Homo sapiens; identical to SEQ ID NO: 535020
  misc_feature: HIJSMM301C4Z8K.18.9.A09.1.454.light.4.raw

SEQ ID NO: 537113 - DNA, 488 bp, Homo sapiens
  misc_feature: HIJSMM301AV4RD.21.55.E11.1.454.light.4.raw
tcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacacctttttaaattggtatcagcacaaaccagggaaggccccaaagctcctgatcgatgctgcatccaatttagagagtggggtcccatccaggttcagtggcgatggatctgggacaaatttcactctcaccatcagcagtctgcaacctgaagattttgcaacttactattgtcaacagagttacagtattcctttcactttcggccctgggaccgaagtcgatatcaaaccgaactgtggctgcaccatctgt

SEQ ID NO: 537114 - DNA, 506 bp, Homo sapiens
  misc_feature: HIJSMM301AGKEY.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtacaaacgaactagtggctgcaccactctgtcttcatcttccccg

SEQ ID NO: 537115 - DNA, 473 bp, Homo sapiens
  misc_feature: HIJSMM301AFZYA.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacgttcggccaagggaccgaaggtggaaatcaaacgaa

SEQ ID NO: 537116 - DNA, 513 bp, Homo sapiens; identical to SEQ ID NO: 535244
  misc_feature: HIJSMM301ARL1X.17.33.C11.1.454.light.4.raw

SEQ ID NO: 537117 - DNA, 505 bp, Homo sapiens
  misc_feature: HIJSMM301CZPCL.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagtcaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcc

SEQ ID NO: 537118 - DNA, 495 bp, Homo sapiens
  misc_feature: HIJSMM301B61AT.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctcgatcgattctctggctccaagtctggcaacacggcctccctgaacatctctgggctccaggctgaggatgaggctgattattattgctgctcatatggaagtacctactcttttctcttcggaactggaccacggtcacctcctaggtcagcccaacggccaacccc

SEQ ID NO: 537119 - DNA, 504 bp, Homo sapiens; identical to SEQ ID NO: 535561
  misc_feature: HIJSMM301CO2F3.4.57.F02.1.454.light.4.raw

SEQ ID NO: 537120 - DNA, 503 bp, Homo sapiens
  misc_feature: HIJSMM301CHN8E.43.53.E09.1.454.light.4.raw
tgtgagtagtcacgaccggtgctcgatttagagagagtgtgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctccccccactattacgttcgaggacggaactagtacaatcaactacgtaccgtagtggtcgtcgtcaccactcttcg

SEQ ID NO: 537121 - DNA, 492 bp, Homo sapiens
  misc_feature: HIJSMM301A8YHR.46.35.D02.1.454.light.4.raw
  modified_base (458)..(458): a, c, t, g, unknown or other
actagcagtacacgaccggtgctcgatttagcacacgatagttgggtttggggagctgctcagttaggacccagagggaaccatggaaaccccacgcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatccccaggcagattcagtggcagtgggtctgggacagacttcactctcaccatcagcagactggagcctgaagattttgcagtctattactgtcagcagtatggtcacgtcccaagaacttttggtccaggggaccgaanctggagatcaaacgaaactgtgggctgcacccat

SEQ ID NO: 537122 - DNA, 510 bp, Homo sapiens
  misc_feature: HIJSMM301BUH7C.17.2.A02.1.454.light.4.raw
cgtagactagcacgaccggtgctcgatttagactcatctacaggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccactgtcactctgttcccgccct

SEQ ID NO: 537123 - DNA, 492 bp, Homo sapiens
  misc_feature: HIJSMM301C6Y9K.49.20.B09.1.454.light.4.raw
agtcgagagacacgaccggtgctcgatttagtgtagtgtgaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggaggactacgctgaccgtcctaggtcagcccaaggctcgccccctcggtcact

SEQ ID NO: 537124 - DNA, 488 bp, Homo sapiens
  misc_feature: HIJSMM301CPBQA.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacgcagccactctgaccatcagcgggacccaggctatggatgaggctgactattattgtcaggcgtgggacagcagcactgcccgttatgtcttcggaactgggaccaaggtcaccgtcttgagtcagcccaaggccaa

SEQ ID NO: 537125 - DNA, 503 bp, Homo sapiens
  misc_feature: HIJSMM301C8J5J.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcttcggccaagggaccaaggtggaaatacaaacgaactagtggctgcaccatctgtcttcatcttccccg

SEQ ID NO: 537126 - DNA, 484 bp, Homo sapiens; identical to SEQ ID NO: 536395
  misc_feature: HIJSMM301BTAES.46.35.D02.1.454.light.4.raw

SEQ ID NO: 537127 - DNA, 486 bp, Homo sapiens
  misc_feature: HIJSMM301DKQ68.3.77.G11.1.454.light.4.raw
agacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcactggtctcccaggcaggttcagtggcagtggatctgggacagaattcacgctcaccatcatcaggctgcggtctgacgacttcgcagtctatttctgtcaacagtacgatggccggcctccgtggacattcggccaaggtaccaaggtggacatcagacgaactgtggctgcacc

SEQ ID NO: 537128 - DNA, 514 bp, Homo sapiens
  misc_feature: HIJSMM301AG6O8.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgcccccctcggtcactctgttcccacctccct

SEQ ID NO: 537129 - DNA, 349 bp, Homo sapiens
  misc_feature: HIJSMM301CUNF7.13.11.A11.1.454.light.4.raw
tcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcaccatctgtcttcatcttcccgccatctgatagtacgtga

SEQ ID NO: 537130 - DNA, 518 bp, Homo sapiens; identical to SEQ ID NO: 535407
  misc_feature: HIJSMM301AUID1.22.30.C08.1.454.light.4.raw

SEQ ID NO: 537131 - DNA, 509 bp, Homo sapiens
  misc_feature: HIJSMM301EBCNZ.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttccca

SEQ ID NO: 537132 - DNA, 499 bp, Homo sapiens
  misc_feature: HIJSMM301DAIT5.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtccgacgggaccgacggtcggtagtgtacaacgacgaactacgttggcgtgcaccatcttcg

SEQ ID NO: 537133 - DNA, 441 bp, Homo sapiens; identical to SEQ ID NO: 534971
  misc_feature: HIJSMM301DWRK9.11.3.A03.1.454.light.4.raw

SEQ ID NO: 537134 - DNA, 484 bp, Homo sapiens; identical to SEQ ID NO: 535400
  misc_feature: HIJSMM301EA6D8.46.26.C04.1.454.light.4.raw

SEQ ID NO: 537135 - DNA, 491 bp, Homo sapiens
  misc_feature: HIJSMM301A3HL9.21.46.E02.1.454.light.4.raw
tcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtcaaacagtagacagtagaggtactcattgggtgttcggcggagggaccaagctgaccgtcctaggtcagcccaaggctgccccctc

SEQ ID NO: 537136 - DNA, 513 bp, Homo sapiens
  misc_feature: HIJSMM301EKEJM.48.14.B03.1.454.light.4.raw
agtatacatacacgaccggtgctcgatttagtgtgagtagttccgcgggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccggtggaataaaacgaactgtggctgcaccatctgtcttcatcttccccg

SEQ ID NO: 537137 - DNA, 444 bp, Homo sapiens; identical to SEQ ID NO: 535192
  misc_feature: HIJSMM301CZ1WN.5.9.A09.1.454.light.4.raw

SEQ ID NO: 537138 - DNA, 503 bp, Homo sapiens
  misc_feature: HIJSMM301EXND6.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatagacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgactcacctcggtccaacgggaacgacgactggtaggaattaaacgtaaactgtggctcgcaccactctcgtcttctat

SEQ ID NO: 537139 - DNA, 492 bp, Homo sapiens; identical to SEQ ID NO: 535426
  misc_feature: HIJSMM301CZE86.47.78.H01.1.454.light.4.raw

SEQ ID NO: 537140 - DNA, 500 bp, Homo sapiens
  misc_feature: HIJSMM301AWO28.49.73.G07.1.454.light.4.raw
agtcgagagacacgaccggtgctcgatttagctctacgctcagggcacgaccggtgctcgatttagtctgacgtcaaagggaaagggggaggaactgctcagttaggacccagagggaaccatggaagccccagctcagcttctcttcctcctgctactctggctcccagataccaccggagaaattgtgttgacacagtctccggccaccctgtccttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgctagtttattactgtcagcagcgtagcaactggcctctctacttcggcggagggaccaaggtggagaac

SEQ ID NO: 537141 - DNA, 479 bp, Homo sapiens
  misc_feature: HIJSMM301C44B9.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaaggtggagatcaaacgaactgtggctgcacc

SEQ ID NO: 537142 - DNA, 485 bp, Homo sapiens
  misc_feature: HIJSMM301AI6IO.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgtcgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccgaacggtggagatcaaacgaactagtggctgcacca

SEQ ID NO: 537143 - DNA, 506 bp, Homo sapiens
  misc_feature: HIJSMM301A60C2.48.85.H08.1.454.light.4.raw
agtatacatacacgaccggtgctcgatttagtatcactcagtcgcgggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaaacgaaactgtggctgcaccatctgtcttc

SEQ ID NO: 537144 - DNA, 486 bp, Homo sapiens
  misc_feature: HIJSMM301AREXC.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgataactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 537145 - DNA, 502 bp, Homo sapiens
  misc_feature: HIJSMM301CZLDB.9.53.E09.1.454.light.4.raw
tgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctggctccaggctgaggacgaggctgattattactgctgctcatatgcagatggtgacactcccgtggtattcggcggagggaccaaggtgaccgtcctaggtcagcccaaggctgccccccg

SEQ ID NO: 537146 - DNA, 449 bp, Homo sapiens
  misc_feature: HIJSMM301AIKAV.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctccagggtcgtctgaccgattctctgcctccaagtctggcacttctgcctccctggtcatatctggtctccagggtggaggatgaggctgattattactgccactcctatgacaacagcctgagtatttggtctgttcggcggcgggaccaagttgaccgtcctacgtcagcccaaggctgccccctccggtcactctgttcccaccctccctccactactatg

SEQ ID NO: 537147 - DNA, 504 bp, Homo sapiens; identical to SEQ ID NO: 535077
  misc_feature: HIJSMM301EE96V.8.28.C06.1.454.light.4.raw

SEQ ID NO: 537148 - DNA, 479 bp, Homo sapiens
  misc_feature: HIJSMM301BY552.21.25.C03.1.454.light.4.raw
tcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcgcgggacc

SEQ ID NO: 537149 - DNA, 488 bp, Homo sapiens
  misc_feature: HIJSMM301ARSK2.51.42.D09.1.454.light.4.raw
cgatcgtatacacgaccggtgctcgatttagacacatacgcagggaaaggggagtcccaaccaggacacagcatggacatgagggtccctactcagctcctggggctcctgctgctctggctctcaggtgccagatgtgacatccagatgacccagtctccgtcctccctgtctgcgtctgtaggagacagagtcaccatcacttgccaggcgagtcaggacattagcaacaatttgatctggtatcagcagaaacctggcagagcccctagtctcatgatctatgatgcatctattttggaagacggggtcccatcccggttcagtgggagtggatctgggacaaatttttctttcaccatcaccaacctgcaacctgaggattttgcaacatatttctgtcaacaatatgataatgtccccaccgtcactttcggcggagggaccaaggtggacctcaaacgaactgtggctgcaccatctgtctt

SEQ ID NO: 537150 - DNA, 496 bp, Homo sapiens
  misc_feature: HIJSMM301BBPXK.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccgaagactggagatcaaccgaactgtggctgcaccatctgtt

SEQ ID NO: 537151 - DNA, 517 bp, Homo sapiens
  misc_feature: HIJSMM301ALGWY.49.11.A11.1.454.light.4.raw
agtcgagagacacgaccggtgctcgatttagctacgactgcagggggctgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaagacggggatgaggccgactattactgtcaggtgtgggatagtggtagtggtgtcgtcttcggagctgggaccagggtcaccggtcctaggtcagcccaaggccaaccccactgtcactctgttcccaccctcctctctctcg

SEQ ID NO: 537152 - DNA, 445 bp, Homo sapiens
  misc_feature: HIJSMM301A4VTP.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccgcccctcctccgtgtctgat

SEQ ID NO: 537153 - DNA, 494 bp, Homo sapiens
  misc_feature: HIJSMM301DQIQ2.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtctaggtcagcccaaggccaaccca

SEQ ID NO: 537154 - DNA, 495 bp, Homo sapiens
  misc_feature: HIJSMM301BRBIB.19.71.G05.1.454.light.4.raw
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaaggtggatatcagacgaactgtggctgca

SEQ ID NO: 537155 - DNA, 497 bp, Homo sapiens; identical to SEQ ID NO: 535286
  misc_feature: HIJSMM301AV7Y4.18.59.F04.1.454.light.4.raw

SEQ ID NO: 537156 - DNA, 488 bp, Homo sapiens
  misc_feature: HIJSMM301A2XAB.19.57.F02.1.454.light.4.raw
tactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttcccctcactttcggcggagggaccaaggtggagatcaagcgaactgtggctgcaccatctgtctt

SEQ ID NO: 537157 - DNA, 487 bp, Homo sapiens
  misc_feature: HIJSMM301EBV8M.51.69.G03.1.454.light.4.raw
cgatcgtatacacgaccggtgctcgatttagtcgctgcgtaaaggagaaaggggagtcagtcccaaccaggacacagcatggacatgagggtccctactcagctcctggggctcctgctgctctggctctcaggtgccagatgtgacatccagatgacccagtctccgtcctccctgtctgcgtctgtaggagacagagtcaccatcacttgccaggcgagtcaggacattagcaacaatttgatctggtatcagcagaaacctggcagagcccctagtctcatgatctatgatgcatctattttggaagacggggtcccatcccggttcagtgggagtggatctgggacaaatttttctttcaccatcaccaacctgcaacctgaggattttgcaacatatttctgtcaacaatatgataatgtccccaccgtcactttcggcggagggaccaaggtggacctcaaacgaactgtggctgcaccat

SEQ ID NO: 537158 - DNA, 496 bp, Homo sapiens; identical to SEQ ID NO: 535109
  misc_feature: HIJSMM301AU4U4.16.78.H01.1.454.light.4.raw

SEQ ID NO: 537159 - DNA, 454 bp, Homo sapiens; identical to SEQ ID NO: 535005
  misc_feature: HIJSMM301CLGA1.19.86.H09.1.454.light.4.raw

SEQ ID NO: 537160 - DNA, 494 bp, Homo sapiens; identical to SEQ ID NO: 535478
  misc_feature: HIJSMM301EETEF.10.79.H02.1.454.light.4.raw

SEQ ID NO: 537161 - DNA, 500 bp, Homo sapiens; identical to SEQ ID NO: 535310
  misc_feature: HIJSMM301CYJ5Q.47.66.F11.1.454.light.4.raw

SEQ ID NO: 537162 - DNA, 496 bp, Homo sapiens
  misc_feature: HIJSMM301DRESH.48.39.D06.1.454.light.4.raw
agtatacatacacgaccggtgctcgatttagtgacatctcgcagttctttgggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 537163 - DNA, 479 bp, Homo sapiens
  misc_feature: HIJSMM301D36ZG.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaa

SEQ ID NO: 537164 - DNA, 486 bp, Homo sapiens; identical to SEQ ID NO: 535917
  misc_feature: HIJSMM301CSXQ3.3.10.A10.1.454.light.4.raw

SEQ ID NO: 537165 - DNA, 495 bp, Homo sapiens
  misc_feature: HIJSMM301BCUX2.51.14.B03.1.454.light.4.raw
cgatcgtatacacgaccggtgctcgatttagtgtgagtagttccgcgggggcaggagtcagaccccgtcaggacacagcatggacatgagggtccccgctcagctcctggggctcctgctgctctggttcccaggttccagatgcgacatccagatgacccagtctccatcctccgtgtctgcatctgtaggagacagagtcaccatgacttgtcgggcgagtcagggtattgacgactacttagcctggcttcagcagaaaccagggaaagcccccaagctcttgatctatgctgcatccaggttggaaagtggggtcccatcaaggttcagcggcagtggatctgggacagatttcactctcaccatcagcagcctgcagcctgaagattttgcaacttattattgtcaacaggctaaaagttaccctctcactttcggcggagggaccaaggtagaaaccaaacgaactgtggctgcaccatctgtcttcta

SEQ ID NO: 537166 - DNA, 494 bp, Homo sapiens; identical to SEQ ID NO: 534992
  misc_feature: HIJSMM301AUW30.9.1.A01.1.454.light.4.raw

SEQ ID NO: 537167 - DNA, 493 bp, Homo sapiens
  misc_feature: HIJSMM301DC55G.16.6.A06.1.454.light.4.raw
  modified_base (482)..(482): a, c, t, g, unknown or other
  modified_base (489)..(489): a, c, t, g, unknown or other
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactaactcctctgacgtgtccaggacgaagtaggaggatcaacgaaaactgngtcgcgnacca

SEQ ID NO: 537168 - DNA, 491 bp, Homo sapiens
  misc_feature: HIJSMM301CX9ZW.51.71.G05.1.454.light.4.raw
cgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgacaaggtcaccgtcctgggtcagcccaaggccaacccactgtca

SEQ ID NO: 537169 - DNA, 447 bp, Homo sapiens; identical to SEQ ID NO: 535882
  misc_feature: HIJSMM301D4HZL.18.9.A09.1.454.light.4.raw
  modified_base (429)..(429): a, c, t, g, unknown or other

SEQ ID NO: 537170 - DNA, 511 bp, Homo sapiens
  misc_feature: HIJSMM301D6J2Y.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctggtgggggttcaatattggaggtaacaatgtgcactggtaccagcagaaggcagggcaggcccctgtactggtcatctatgggggatccatccggccaggtcgggacccctgcgcgattctctgcctccatctcggggaacgcggccaccctgaccatcagcaaagcccaagccggtgatgaggctgacttatttttgtcaggtgtgggacagcagcatttatgtcttcggacctgggaccaaggtcaccgtcctaggtcagcccaaggccaaccccactgtcactctgttccccaccct

SEQ ID NO: 537171 - DNA, 488 bp, Homo sapiens
  misc_feature: HIJSMM301CJFW6.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttct

SEQ ID NO: 537172 - DNA, 489 bp, Homo sapiens
  misc_feature: HIJSMM301D6Z0I.14.68.G02.1.454.light.4.raw
cgtctagtaccacgaccggtgctcgatttagtcgatagtgaagggaaaggggcgagagtcagtcccaacccaggacacagcatggacatgagggtccctcgctcagctcctggggcgtcctgctgctctggctctcaggtgccagatgtgacatccagatgacccagtctccatcctccctgtctgcatctgtaggagacagagtcaccatcacttgccaggcgagtcaggacatcaggaaatatttaaattggtatcagcagaaaccagggaaagcccctaaactcctgatcttcgatgcatccaatttggaaacaggggtcccatcaaggttcaggggaagtggatctgggacagattttagtttcaccatcagcagcctgcagcctgaagatattggaacatattactgtcaacagtatgataatttaccgctcactttcggcggagggaccaaggtggacatcaaacgaactgtggctgcaccat

SEQ ID NO: 537173 - DNA, 520 bp, Homo sapiens
  misc_feature: HIJSMM301C1YD1.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccacct

SEQ ID NO: 537174 - DNA, 495 bp, Homo sapiens
  misc_feature: HIJSMM301A6PW5.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcgctctcaccatcagcagcctagagcctgaagattttgcagtttattactgtcagcagcgtagcaactggcctctcactttcggcggagggaccaaggtggagatcaaacgaactgtggctgcaccatctgtctt

SEQ ID NO: 537175 - DNA, 483 bp, Homo sapiens
  misc_feature: HIJSMM301A4X18.40.15.B04.1.454.light.4.raw
tctagcgactcacgaccggtgctcgatttagacagtatatatccgcgggaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgttggcaaccaaggagcaacttggctgcagcagcaccagggccaccctcccaaagtcctatccgacaggaataacaaccggccctcagggatctcagagagaatatctgcatccaggtcaggaaacacagcctccctgaccattactggactccagcctgaggacgaggctgactattattgctcagcatgggacaccagcctcaatgccgcggtattcggcgcagggaccaagctgaccgtcctaggtcagcccg

SEQ ID NO: 537176 - DNA, 491 bp, Homo sapiens
  misc_feature: HIJSMM301DVM12.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 537177 - DNA, 508 bp, Homo sapiens
  misc_feature: HIJSMM301BDWXP.40.67.G01.1.454.light.4.raw
  modified_base (435)..(435): a, c, t, g, unknown or other
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccagccaggttcagtggcagtgggtctgggacagccttcactctcaccatcagcagcctggagcccgaagattttgcggtttattactgtcagcagcgtgccgactggccccctnacgttcggcggagggaccaaggtggacatcaaacgaactgtggctgcaccatctgtcttcatcttcccgccta

SEQ ID NO: 537178 - DNA, 516 bp, Homo sapiens
  misc_feature: HIJSMM301A62SS.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagatttgcaacttactactgtcaacagagttacagtaccccctcctctacgttcggacgggacggaacgaggacggagactacgaacgaacgtaacgttggtcggtcgcgaccaacctacttcgttcgttcctta

SEQ ID NO: 537179 - DNA, 491 bp, Homo sapiens; identical to SEQ ID NO: 535294
  misc_feature: HIJSMM301DJNJH.16.68.G02.1.454.light.4.raw

SEQ ID NO: 537180 - DNA, 493 bp, Homo sapiens
  misc_feature: HIJSMM301CF34W.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagccaaggctgccccctcggtcact

SEQ ID NO: 537181 - DNA, 509 bp, Homo sapiens
  misc_feature: HIJSMM301AKKKJ.49.25.C03.1.454.light.4.raw
agtcgagagacacgaccggtgctcgatttagtagtgtagatttgggtttggggagaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagtattttgcagtctattactgtcagcagtcgttacaactggccctcccatgtactacgttttcggccgacggggaaccaagcgtaggaaatcagaacgaactggtggctgccaccatctgtt

SEQ ID NO: 537182 - DNA, 505 bp, Homo sapiens; identical to SEQ ID NO: 535503
  misc_feature: HIJSMM301A6LZK.8.28.C06.1.454.light.4.raw

SEQ ID NO: 537183 - DNA, 485 bp, Homo sapiens; identical to SEQ ID NO: 536210
  misc_feature: HIJSMM301BHLQ5.43.54.E10.1.454.light.4.raw

SEQ ID NO: 537184 - DNA, 490 bp, Homo sapiens
  misc_feature: HIJSMM301ASOL5.21.4.A04.1.454.light.4.raw
tcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgtagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaagggaccaaggtagaaatgaaacgaactgtggctgcaccatctgt

SEQ ID NO: 537185 - DNA, 484 bp, Homo sapiens
  misc_feature: HIJSMM301EORD2.5.40.D07.1.454.light.4.raw
atcagacacgcacgaccggtgctcgatttagtgatagagcgtaacaacagagggggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggaccaaggtggagaccaaacgaactgtggctgcaccatct

SEQ ID NO: 537186 - DNA, 479 bp, Homo sapiens
  misc_feature: HIJSMM301DJWGP.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccagggaccaagctggagatcaaacgaa

SEQ ID NO: 537187 - DNA, 511 bp, Homo sapiens
  misc_feature: HIJSMM301AJ4E3.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgttacttttcggcggagggaccaagctcgaccgtccgtgggtcacgacccaaggctcgccccctcggtccta

SEQ ID NO: 537188 - DNA, 486 bp, Homo sapiens; identical to SEQ ID NO: 535385
  misc_feature: HIJSMM301CUYCY.19.71.G05.1.454.light.4.raw

SEQ ID NO: 537189 - DNA, 503 bp, Homo sapiens
  misc_feature: HIJSMM301BPVFK.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggt

SEQ ID NO: 537190 - DNA, 511 bp, Homo sapiens
  misc_feature: HIJSMM301CYWFE.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccaagggaccaacggtaggaagtacaaacgaactagtggcgtgcaccatctgtcttctatcttcccgtccact

SEQ ID NO: 537191 - DNA, 483 bp, Homo sapiens
  misc_feature: HIJSMM301CDDCN.49.28.C06.1.454.light.4.raw
agtcgagagacacgaccggtgctcgatttagagctcacgtattgggtttggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggtccaggggaccaagctggagatcaagcgaactgtggctgcaccat

SEQ ID NO: 537192 - DNA, 380 bp, Homo sapiens
  misc_feature: HIJSMM301CH7LG.12.14.B03.1.454.light.4.raw
atacgacgtacacgaccggtgctcgatttagtgtgagtagtttgagtttgggggccgttcctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccaccctcctctacgtcgtat

SEQ ID NO: 537193 - DNA, 444 bp, Homo sapiens; identical to SEQ ID NO: 535856
  misc_feature: HIJSMM301EJ0K4.9.9.A09.1.454.light.4.raw

SEQ ID NO: 537194 - DNA, 482 bp, Homo sapiens; identical to SEQ ID NO: 537007
  misc_feature: HIJSMM301CQZXJ.41.34.D01.1.454.light.4.raw

SEQ ID NO: 537195 - DNA, 447 bp, Homo sapiens
  misc_feature: HIJSMM301D5BF1.18.9.A09.1.454.light.4.raw
tacgagtatgcacgaccggtgctcgatttagcgagacgcgcagggtcctgggcccagtctgtgctgacgcagccgccctcagtgtctggggcgccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 537196 - DNA, 443 bp, Homo sapiens
  misc_feature: HIJSMM301CK9OI.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattatactgccactcctatgacaacagcctgagtatttggctgttcggcggcgggaccaagttgaccgtcctacgtcagcccaaggctgccccctcggtcactctgttcccaccctcctcgacacgcgag

SEQ ID NO: 537197 - DNA, 484 bp, Homo sapiens
  misc_feature: HIJSMM301BS5YE.10.38.D05.1.454.light.4.raw
catagtagtgcacgaccggtgctcgatttagtatctgatagttgggtttggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgttttgtaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccaccctcctccactactatg

SEQ ID NO: 537198 - DNA, 484 bp, Homo sapiens; identical to SEQ ID NO: 535240
  misc_feature: HIJSMM301AX227.47.60.F05.1.454.light.4.raw

SEQ ID NO: 537199 - DNA, 489 bp, Homo sapiens; identical to SEQ ID NO: 535139
  misc_feature: HIJSMM301BE0WW.14.55.E11.1.454.light.4.raw

SEQ ID NO: 537200 - DNA, 501 bp, Homo sapiens; identical to SEQ ID NO: 535746
  misc_feature: HIJSMM301BKHPO.18.11.A11.1.454.light.4.raw

SEQ ID NO: 537201 - DNA, 486 bp, Homo sapiens; identical to SEQ ID NO: 535043
  misc_feature: HIJSMM301C9NWJ.46.35.D02.1.454.light.4.raw

SEQ ID NO: 537202 - DNA, 492 bp, Homo sapiens
  misc_feature: HIJSMM301ASJ05.48.86.H09.1.454.light.4.raw
agtatacatacacgaccggtgctcgatttagtgctatagacttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccccg

SEQ ID NO: 537203 - DNA, 494 bp, Homo sapiens
  misc_feature: HIJSMM301B0VG5.10.17.B06.1.454.light.4.raw
catagtagtgcacgaccggtgctcgatttagtcgatagtgaagggggaggaactgctcagttaggacccacgacggaaccatggaagccccacgcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccgggggaccaagctggaaatcaagcgaactgtggctgcaccatctgtcttcat

SEQ ID NO: 537204 - DNA, 515 bp, Homo sapiens
  misc_feature: HIJSMM301BJ4C2.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatattttgtcaggtgtgggagactaattttggtcatatgttgttcggcggagggaccaagctgaccgtcctcggtcagcccaaggctgccccctcggtcactctgttcccaccctcct

SEQ ID NO: 537205 - DNA, 482 bp, Homo sapiens
  misc_feature: HIJSMM301AY9UQ.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaactgtggctgcaccat

SEQ ID NO: 537206 - DNA, 499 bp, Homo sapiens
  misc_feature: HIJSMM301AJ5NQ.52.28.C06.1.454.light.4.raw
cgcagtacgacacgaccggtgctcgatttagagctcacgtattgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcat

SEQ ID NO: 537207 - DNA, 487 bp, Homo sapiens; identical to SEQ ID NO: 536206
  misc_feature: HIJSMM301DKZ74.47.38.D05.1.454.light.4.raw

SEQ ID NO: 537208 - DNA, 487 bp, Homo sapiens
  misc_feature: HIJSMM301CA316.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactgtggctgcaccatctgt

SEQ ID NO: 537209 - DNA, 486 bp, Homo sapiens
  misc_feature: HIJSMM301BIGJI.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctaccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcgccaagggaccaaggtggaatcaaacgaactgtggctgcaccat

SEQ ID NO: 537210 - DNA, 498 bp, Homo sapiens
  misc_feature: HIJSMM301CPXLK.41.71.G05.1.454.light.4.raw
tctatactatcacgaccggtgctcgatttagtgtcgtcgcaagagagaggggagtcagacccagtcaggacacagcatggacatgagggtccccgctcagctcctgggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaattaaacgaactgtggctgcaccatctgtcttcatcttcccg

SEQ ID NO: 537211 - DNA, 508 bp, Homo sapiens
  misc_feature: HIJSMM301BZJEP.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggctgccccccg

SEQ ID NO: 537212 - DNA, 373 bp, Homo sapiens
  misc_feature: HIJSMM301D5QS8.21.25.C03.1.454.light.4.raw
tcgtcgctcgcacgaccggtgctcgatttagtagtgtagatttgggtttgggagcagctccaacatcgggtcaccttttgatgtgcactggtatcagcaacttccaggaacagcccccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggtttttggctgttcggcggcgggaccaagctgaccgtcctaggtcagcccaaggctgccccctcggtcactctgttcccgccctcctccgagcgacga

SEQ ID NO: 537213 - DNA, 494 bp, Homo sapiens; identical to SEQ ID NO: 534992
  misc_feature: HIJSMM301DEVWS.9.1.A01.1.454.light.4.raw

SEQ ID NO: 537214 - DNA, 464 bp, Homo sapiens
  misc_feature: HIJSMM301CMCTF.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccgccctcctccatactcgta

SEQ ID NO: 537215 - DNA, 487 bp, Homo sapiens
  misc_feature: HIJSMM301BLPF4.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcgccaaggacgacgactggagattaacgaaactgtggctgcaccatctgtcttc

SEQ ID NO: 537216 - DNA, 503 bp, Homo sapiens
  misc_feature: HIJSMM301CKXZF.3.70.G04.1.454.light.4.raw
agacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccacttagcctggtaccagcagaaacctggccagcctcccagtctcctcatctatggagcacacaacagggccactggcatcccagccaggttcagtggcagtgggtctgggacagacttcaccctcatcatcagccgcctagagcctgaagattttgcagtttattactgtcagcagggttacttctggcccactttcggccctgggaccaaagtggatatcaaacgaactgtggctgcaccatctgtcttcatcttcccgccat

SEQ ID NO: 537217 - DNA, 487 bp, Homo sapiens; identical to SEQ ID NO: 536196
  misc_feature: HIJSMM301B5KAU.11.28.C06.1.454.light.4.raw

SEQ ID NO: 537218 - DNA, 496 bp, Homo sapiens
  misc_feature: HIJSMM301A69W3.51.87.H10.1.454.light.4.raw
cgatcgtatacacgaccggtgctcgatttagcagtactgcgttgggtttgggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcagcatcacttgccgggccactgagaatattcataattggttggcctggtatcagcagaaaccagggaaagcccctaaactcctgatatataagacgtctaatttagaaggtggggtcccatcaaggttcagcggcggtggctctgggacagaattcactctcaccatcaccagcctgcagcctgatgattttgcaacttattactgccaacagtattatagttattggacgttcggccaagggaccaaggtggaaatcaaacgaactgtggctgcaccatctgtcttcatcttcccg

SEQ ID NO: 537219 - DNA, 484 bp, Homo sapiens; identical to SEQ ID NO: 535400
  misc_feature: HIJSMM301AFRLT.46.26.C04.1.454.light.4.raw

SEQ ID NO: 537220 - DNA, 487 bp, Homo sapiens
  misc_feature: HIJSMM301B1DI7.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaa

SEQ ID NO: 537221 - DNA, 487 bp, Homo sapiens; identical to SEQ ID NO: 537009
  misc_feature: HIJSMM301BV6O9.12.88.H11.1.454.light.4.raw

SEQ ID NO: 537222 - DNA, 486 bp, Homo sapiens; identical to SEQ ID NO: 535043
  misc_feature: HIJSMM301DPQO4.46.35.D02.1.454.light.4.raw

SEQ ID NO: 537223 - DNA, 502 bp, Homo sapiens; identical to SEQ ID NO: 535463
  misc_feature: HIJSMM301DK3HC.43.86.H09.1.454.light.4.raw

SEQ ID NO: 537224 - DNA, 495 bp, Homo sapiens; identical to SEQ ID NO: 535596
  misc_feature: HIJSMM301CLH8J.10.79.H02.1.454.light.4.raw

SEQ ID NO: 537225 - DNA, 496 bp, Homo sapiens
  misc_feature: HIJSMM301C9OTR.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaacccca

SEQ ID NO: 537226 - DNA, 503 bp, Homo sapiens
  misc_feature: HIJSMM301D1UCU.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtc

SEQ ID NO: 537227 - DNA, 494 bp, Homo sapiens; identical to SEQ ID NO: 534992
  misc_feature: HIJSMM301AGBAC.9.1.A01.1.454.light.4.raw

SEQ ID NO: 537228 - DNA, 500 bp, Homo sapiens
  misc_feature: HIJSMM301DO0JT.9.12.B01.1.454.light.4.raw
  modified_base (427)..(427): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtcctgaccgattcagtggcagcgggtctgggacagatttcactctcaccatcagcagcctgcaggctgaagatgtggcagtttatactgtcaacagttttcncgggcgttgccaggaccaacggtggaaatactaacgaactagtggctgcgaccatctgtcttcatcttccccg

SEQ ID NO: 537229 - DNA, 494 bp, Homo sapiens
  misc_feature: HIJSMM301B7UE5.52.42.D09.1.454.light.4.raw
cgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 537230 - DNA, 504 bp, Homo sapiens
  misc_feature: HIJSMM301CMOT4.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctctacttcgtcggacggacggaacgaggacggagtcacgacgaactacgtggtcgtcgcgaccaactcttcgtcttccta

SEQ ID NO: 537231 - DNA, 501 bp, Homo sapiens
  misc_feature: HIJSMM301CJLSP.19.67.G01.1.454.light.4.raw
tactctcgtgcacgaccggtgctcgatttagagtatacatattgggtttggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttctatcctccgtggacgttcggccaagggaccaggtggaaatcagacgaactgtggctgcaccat

SEQ ID NO: 537232 - DNA, 482 bp, Homo sapiens; identical to SEQ ID NO: 535796
  misc_feature: HIJSMM301EIT2G.51.64.F09.1.454.light.4.raw

SEQ ID NO: 537233 - DNA, 494 bp, Homo sapiens; identical to SEQ ID NO: 534994
  misc_feature: HIJSMM301EOWQK.27.78.H01.1.454.light.4.raw

SEQ ID NO: 537234 - DNA, 492 bp, Homo sapiens
  misc_feature: HIJSMM301ASDT6.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccttgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccat

SEQ ID NO: 537235 - DNA, 479 bp, Homo sapiens
  misc_feature: HIJSMM301B77CV.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccaggggaccaagctggagatcaacgaa

SEQ ID NO: 537236 - DNA, 447 bp, Homo sapiens; identical to SEQ ID NO: 535201
  misc_feature: HIJSMM301AH830.18.9.A09.1.454.light.4.raw

SEQ ID NO: 537237 - DNA, 494 bp, Homo sapiens
  misc_feature: HIJSMM301BEEOJ.17.39.D06.1.454.light.4.raw
cgtagactagcacgaccggtgctcgatttagtgacatctcgcagttctttgggggggaggaactgctcagttaggacccacgacggaaccatggaagccccacgcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccgaagggaccgaaggtggaaagtacaaacgaactgtggctgca

SEQ ID NO: 537238 - DNA, 486 bp, Homo sapiens
  misc_feature: HIJSMM301CGHC9.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 537239 - DNA, 493 bp, Homo sapiens
  misc_feature: HIJSMM301B2BQF.49.66.F11.1.454.light.4.raw
agtcgagagacacgaccggtgctcgatttagtcacgcgagaaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttcccg

SEQ ID NO: 537240 - DNA, 444 bp, Homo sapiens; identical to SEQ ID NO: 534993
  misc_feature: HIJSMM301BJ8MQ.5.9.A09.1.454.light.4.raw

SEQ ID NO: 537241 - DNA, 486 bp, Homo sapiens
  misc_feature: HIJSMM301DSXQU.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactagtggctgcaccatctgtt

SEQ ID NO: 537242 - DNA, 453 bp, Homo sapiens; identical to SEQ ID NO: 536065
  misc_feature: HIJSMM301EO48S.18.78.H01.1.454.light.4.raw

SEQ ID NO: 537243 - DNA, 485 bp, Homo sapiens
  misc_feature: HIJSMM301AXRJH.49.64.F09.1.454.light.4.raw
  modified_base (483)..(483): a, c, t, g, unknown or other
agtcgagagacacgaccggtgctcgatttagcgcgtatacaagggggcaggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaaagaactgtggctgcaccatcngt

SEQ ID NO: 537244 - DNA, 510 bp, Homo sapiens
  misc_feature: HIJSMM301AQSH3.48.15.B04.1.454.light.4.raw
agtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcgccggggaccgaacgtggaaagtacaaacgaaactgtggctgcaccatctgtcttcta

SEQ ID NO: 537245 - DNA, 447 bp, Homo sapiens; identical to SEQ ID NO: 535020
  misc_feature: HIJSMM301CSQGT.18.9.A09.1.454.light.4.raw

SEQ ID NO: 537246 - DNA, 492 bp, Homo sapiens
  misc_feature: HIJSMM301BZLXD.43.28.C06.1.454.light.4.raw
tgtgagtagtcacgaccggtgctcgatttagagctcacgtattgggtttgggggatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtactggaggcacctacttgagttggtttcaccagaggccaggccaatctccaaggcgtctgatttataagatttctatccgggactctggggtcccagacaggttcagcggcagtgggtcagacactgacttcacactgagaatcagcagggtggaggctgaggatgttggaatttattactgcatgcaatcttcacactggcctccgtacacttttggccaggggaccaagctggagatcaaacgaactgtgg

SEQ ID NO: 537247 - DNA, 487 bp, Homo sapiens
  misc_feature: HIJSMM301BFC1T.47.70.G04.1.454.light.4.raw
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagattttcactctcaccatcagcagtctgcaacctgaagattttgcaacttactactgtcaacagagttacggtaccccgtacacttttggccaggggaccaaactggacatcaaacgaactgtggctgcaccatctgt

SEQ ID NO: 537248 - DNA, 504 bp, Homo sapiens
  misc_feature: HIJSMM301DZV5O.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggtcggagggaccaagctgaccgtcctgggtcagcccaaggctgccccctcggtca

SEQ ID NO: 537249 - DNA, 496 bp, Homo sapiens
  misc_feature: HIJSMM301D4C4J.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgactgtggctgcaccatctgtt

SEQ ID NO: 537250 - DNA, 415 bp, Homo sapiens; identical to SEQ ID NO: 536482
  misc_feature: HIJSMM301CNC81.16.46.E02.1.454.light.4.raw

SEQ ID NO: 537251 - DNA, 484 bp, Homo sapiens
  misc_feature: HIJSMM301BAHZ5.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccaggctcctcatctatgatgcatccaacagggccactggcatcccagccaggttcagtggcagtgggtctgtgacagacttcactctcaccatcagcagcctagagcctgaagattttgcagtttattactgtcaacagcgtaccacaggattcactttcggccctgggaccagagtggatatcaaacgaactgtggctgcaccatctgtcttc

SEQ ID NO: 537252 - DNA, 462 bp, Homo sapiens
  misc_feature: HIJSMM301EN46W.26.78.H01.1.454.light.4.raw
agactatactcacgaccggtgctcgatttagtgtgagtagtttgggtttggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcgagggaccagggtggagatcagacgaactgtggctgcaccatctgtcttcatcttcccgccatctgaagtatagtct

SEQ ID NO: 537253 - DNA, 495 bp, Homo sapiens; identical to SEQ ID NO: 535821
  misc_feature: HIJSMM301A2MVE.3.31.C09.1.454.light.4.raw

SEQ ID NO: 537254 - DNA, 485 bp, Homo sapiens; identical to SEQ ID NO: 535018
  misc_feature: HIJSMM301AJ4MG.46.35.D02.1.454.light.4.raw

SEQ ID NO: 537255 - DNA, 518 bp, Homo sapiens
  misc_feature: HIJSMM301DYRKA.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggctgccccctcggtcactctcgttcccgccctcctccacg

SEQ ID NO: 537256 - DNA, 503 bp, Homo sapiens
  misc_feature: HIJSMM301C0DWN.48.60.F05.1.454.light.4.raw
agtatacatacacgaccggtgctcgatttagtacgtcatcagggaaagggggaagagctgctcagttaggacccagagggaaccatggaaaccccagcgcagcttctcttcctcctgctactctggctcccagataccgccggagaaattttgttgacgcagtctccaggcaccctgtctttgtctccaggggaaagagccaccctctcctgcagggccagtcagtatgttagcagcaactacttagcctggtaccagcagaaacctggccaggctcccaggctcctcatctacggtgcatccagcagggccattggcatcccagacaggttcagtggcagtgggtctgggacaaacttcactctcaccatcagcagactggagcctgaagattttgcagtctattactgtcagcagtatactaactcacctaagacgttcggccaagggaccaaggtggaaatcaaacgaactgtggctgcaccatctgtcttcatcttccg

SEQ ID NO: 537257 - DNA, 484 bp, Homo sapiens; identical to SEQ ID NO: 536162
  misc_feature: HIJSMM301CNB9C.13.59.F04.1.454.light.4.raw

SEQ ID NO: 537258 - DNA, 384 bp, Homo sapiens
  misc_feature: HIJSMM301BHM9Q.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgcccatctgaatagtataga

SEQ ID NO: 537259 - DNA, 447 bp, Homo sapiens; identical to SEQ ID NO: 535882
  misc_feature: HIJSMM301D12Y9.18.9.A09.1.454.light.4.raw
  modified_base (429)..(429): a, c, t, g, unknown or other

SEQ ID NO: 537260 - DNA, 488 bp, Homo sapiens
  misc_feature: HIJSMM301BJWCF.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgtt

SEQ ID NO: 537261 - DNA, 520 bp, Homo sapiens
  misc_feature: HIJSMM301BGXKH.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctactacgttcggacggacggaacgaggacggagtactacgacggaacgtaacgttggtcggtctcgacccaacctacttcgttcgtttcctta

SEQ ID NO: 537262 - DNA, 501 bp, Homo sapiens
  misc_feature: HIJSMM301AKG29.8.55.E11.1.454.light.4.raw
ctcgcgtgtccacgaccggtgctcgatttagcactcgcacgttgggtttggggagctctgcttcagctgtgagcgcagaaggcaggactcgggacaatcgtcatcatgacctgctcccctctcctcctcacccttctcattcactgcacagggtcctgggcccagcctgtgttgacgcaggcgccctcagtatctgcggccccgggacagagggtcaccatctcctgctccggaagcacctcaaatattggggacagttttgtatcgtggtatcagcaagtccccggaacagcccccaaactcctcatttatgaggataatgagcgacgttcaggaattcctgaccgtttctctggctccaagtctggcacgtcagccaccctgggcatcaccggactccagactggggacgaggccgactattactgcggagcatgggatagcagcctgaacactgtggtcttcggcggagggaccaagctgaccgtccttagtcagccc

SEQ ID NO: 537263 - DNA, 499 bp, Homo sapiens
  misc_feature: HIJSMM301BSTQD.15.25.C03.1.454.light.4.raw
tctacgtagccacgaccggtgctcgatttagtagtgtagatttgggtttgggggatcaggactcctcatttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttgggggtttattactgcatgcaaggtctacaaaccccgatcaccttcggccgagggacacgcctggagattaaacgaactgtggctgcaccat

SEQ ID NO: 537264 - DNA, 497 bp, Homo sapiens
  misc_feature: HIJSMM301E1IJM.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagacaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggtccaagggaccgaaggtaggaaggtcaaacgaaactgtggcgtgcaccatctgtctt

SEQ ID NO: 537265 - DNA, 504 bp, Homo sapiens
  misc_feature: HIJSMM301EDQNK.48.59.F04.1.454.light.4.raw
agtatacatacacgaccggtgctcgatttagtacacacacttagggattgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 537266 - DNA, 493 bp, Homo sapiens; identical to SEQ ID NO: 535657
  misc_feature: HIJSMM301C8535.27.78.H01.1.454.light.4.raw

SEQ ID NO: 537267 - DNA, 488 bp, Homo sapiens; identical to SEQ ID NO: 536861
  misc_feature: HIJSMM301DHO00.12.88.H11.1.454.light.4.raw

SEQ ID NO: 537268 - DNA, 505 bp, Homo sapiens
  misc_feature: HIJSMM301A4YKC.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagactgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtctt

SEQ ID NO: 537269 - DNA, 511 bp, Homo sapiens
  misc_feature: HIJSMM301EKW0H.17.33.C11.1.454.light.4.raw
cgtagactagcacgaccggtgctcgatttagagtgagctcgttgggtttgggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtgtgctgtgctattcggcggagggaccaagctgaccgtcttaagtcagcccaaggctgccccctcggtcactctgttcccaccctctt

SEQ ID NO: 537270 - DNA, 454 bp, Homo sapiens; identical to SEQ ID NO: 536943
  misc_feature: HIJSMM301EDWU3.19.86.H09.1.454.light.4.raw

SEQ ID NO: 537271 - DNA, 440 bp, Homo sapiens
  misc_feature: HIJSMM301D0JDI.41.9.A09.1.454.light.4.raw
tctatactatcacgaccggtgctcgatttagcgagacgcgcagggtcctgggcccagtctgtcctgactcagccaccctcagcgtctgggacccccggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccgccctcctcatagtataga

SEQ ID NO: 537272 - DNA, 494 bp, Homo sapiens
  misc_feature: HIJSMM301BYT9R.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggccagggggaccaacctggagatcaaatgaactgtggctgcaccatctgtctt

SEQ ID NO: 537273 - DNA, 495 bp, Homo sapiens
  misc_feature: HIJSMM301EE9TY.15.26.C04.1.454.light.4.raw
tctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatt

SEQ ID NO: 537274 - DNA, 500 bp, Homo sapiens
  misc_feature: HIJSMM301EDYGA.43.29.C07.1.454.light.4.raw
tgtgagtagtcacgaccggtgctcgatttagagtgctacgagggaaagggcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggagagggaccagggtggagata

SEQ ID NO: 537275 - DNA, 444 bp, Homo sapiens; identical to SEQ ID NO: 535192
  misc_feature: HIJSMM301BH04U.5.9.A09.1.454.light.4.raw

SEQ ID NO: 537276 - DNA, 488 bp, Homo sapiens
  misc_feature: HIJSMM301DYQ6I.19.57.F02.1.454.light.4.raw
tactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttccccctcactttcggcggagggaccaagtggagatcaagcgaactgtggctgcaccatctgtctt

SEQ ID NO: 537277 - DNA, 496 bp, Homo sapiens
  misc_feature: HIJSMM301BTBEB.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcattcc

SEQ ID NO: 537278 - DNA, 500 bp, Homo sapiens
  misc_feature: HIJSMM301DJUBS.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattgctgtttgacttggcacaacaacgcctggatcttcggacctgggaccacggtcaccgtcctaggtcagcccaaggccaaccccactgtcactctcg

SEQ ID NO: 537279 - DNA, 416 bp, Homo sapiens
  misc_feature: HIJSMM301BAWID.18.78.H01.1.454.light.4.raw
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaaccccactgtcactctgttcccgccctcctccatactcgta

SEQ ID NO: 537280 - DNA, 455 bp, Homo sapiens
  misc_feature: HIJSMM301D2MS4.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgacctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 537281 - DNA, 493 bp, Homo sapiens
  misc_feature: HIJSMM301CCKKV.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttcccg

SEQ ID NO: 537282 - DNA, 490 bp, Homo sapiens; identical to SEQ ID NO: 535234
  misc_feature: HIJSMM301BACML.17.21.B10.1.454.light.4.raw

SEQ ID NO: 537283 - DNA, 505 bp, Homo sapiens; identical to SEQ ID NO: 536233
  misc_feature: HIJSMM301AZGI1.48.25.C03.1.454.light.4.raw

SEQ ID NO: 537284 - DNA, 483 bp, Homo sapiens; identical to SEQ ID NO: 535317
  misc_feature: HIJSMM301AL97Q.4.1.A01.1.454.light.4.raw

SEQ ID NO: 537285 - DNA, 499 bp, Homo sapiens
  misc_feature: HIJSMM301B5PM4.9.1.A01.1.454.light.4.raw
  modified_base (490)..(490): a, c, t, g, unknown or other
tgatacgtctcacgaccggtgctcgatttagacgtctcatcaggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaaggacgacgaactggagattaaaggaaacgtgtggctgcaccactctgtcttctanctttccccg

SEQ ID NO: 537286 - DNA, 477 bp, Homo sapiens
  misc_feature: HIJSMM301AO2KY.49.57.F02.1.454.light.4.raw
agtcgagagacacgaccggtgctcgatttagctcgatatagttgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggtcgggggacgaacgtggagatcaagcgaactgt

SEQ ID NO: 537287 - DNA, 503 bp, Homo sapiens
  misc_feature: HIJSMM301C50B9.47.65.F10.1.454.light.4.raw
agctcacgtacacgaccggtgctcgatttagctacgctctaaggggagctgtgggtagagaagacaggactcaggacaatctccagcatggccagcttccctctcctcctcaccctcctcactcactgtgcagggtcctgggcccagtctgcgttgactcagccaccctcagtgtctgggacccccggcagacggtcgccgtctcttgttctggaagcggctccaacatcggccgtaattctgtaaactggtaccagcagctcccaggaatggcccccacactcctcatctatagggatgatcagtggccctcaggggtccctgaccgattctctggctccaagtctggcacttcagcctccctggccatcagtgggctccagtctggggatgaggctgattattactgtgcaacatgggatgacagtctgaacgcaatggtgttcggcggagggaccaaggtggccgtcctaggtcagcccaaggctgccccctcggtcact

SEQ ID NO: 537288 - DNA, 497 bp, Homo sapiens
  misc_feature: HIJSMM301DRMEN.15.25.C03.1.454.light.4.raw
tctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactgtggctgcacc

SEQ ID NO: 537289 - DNA, 448 bp, Homo sapiens
  misc_feature: HIJSMM301CPZPX.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccgacccctccctccgtcgtctgat

SEQ ID NO: 537290 - DNA, 506 bp, Homo sapiens
  misc_feature: HIJSMM301BQQ4M.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctgttccccg

SEQ ID NO: 537291 - DNA, 496 bp, Homo sapiens
  misc_feature: HIJSMM301CZP9C.13.67.G01.1.454.light.4.raw
tcacgtactacacgaccggtgctcgatttagagtatacatattgggtttggggagctacaacaggcaggcaggggcgagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgt

SEQ ID NO: 537292 - DNA, 498 bp, Homo sapiens
  misc_feature: HIJSMM301CBHNT.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgaagattttgcagtttattactgtcagcagcgtagcatctggcctccgtacacctttggccaggggaccaagctggagatcaacgaactgtggctgcaccatctgtcttcat

SEQ ID NO: 537293 - DNA, 479 bp, Homo sapiens; identical to SEQ ID NO: 535665
  misc_feature: HIJSMM301BFA21.12.10.A10.1.454.light.4.raw

SEQ ID NO: 537294 - DNA, 489 bp, Homo sapiens
  misc_feature: HIJSMM301C7NC1.41.44.D11.1.454.light.4.raw
tctatactatcacgaccggtgctcgatttagcgcagtacgaagggggcggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagtcatctctggggtccagtttgtggatgaggctgactactattgcacggtctggtacagcagcgctgtggtcttcggcggagggactgaacttatcgtcctaggtcagcccaaggctcg

SEQ ID NO: 537295 - DNA, 497 bp, Homo sapiens
  misc_feature: HIJSMM301ADEHH.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattaattatacttcgtggacgttcggccaacggaccgaaggtaggagtatcagacgaactagtgg

SEQ ID NO: 537296 - DNA, 504 bp, Homo sapiens
  misc_feature: HIJSMM301CM6X0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttctcggcgtcgtcgacggacgaacgaggaagacaacgaactagtggcgtgcgaccactctgttcttctactcttccccg

SEQ ID NO: 537297 - DNA, 506 bp, Homo sapiens
  misc_feature: HIJSMM301B389W.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaaggaccgaaggtaggaaagtacaaacgaactagtggctgcaccatctgtcttcatcttccccg

SEQ ID NO: 537298 - DNA, 502 bp, Homo sapiens
  misc_feature: HIJSMM301B7X1C.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttacctcaagtgatcaccttcggccaagggacacgactggagattaaacg

SEQ ID NO: 537299 - DNA, 501 bp, Homo sapiens
  misc_feature: HIJSMM301AKC7V.27.78.H01.1.454.light.4.raw
  modified_base (458)..(458): a, c, t, g, unknown or other
agcgtcgtctcacgaccggtgctcgatttagtgtgagtagtttgggtttgggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtacttacttaccttcaagtgatcaccttcgccgaacggacacgacnggagattaaaacgtaaactgtggcgtgcacccatcttgtcttt

SEQ ID NO: 537300 - DNA, 497 bp, Homo sapiens
  misc_feature: HIJSMM301BBBD0.9.53.E09.1.454.light.4.raw
tgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaagg

SEQ ID NO: 537301 - DNA, 505 bp, Homo sapiens
  misc_feature: HIJSMM301B7M5Y.49.38.D05.1.454.light.4.raw
  modified_base (463)..(463): a, c, t, g, unknown or other
agtcgagagacacgaccggtgctcgatttagtatctgatagttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaataattcggcggagggaccaagctnaccgtcctaggtcagcccaaggctgccccctccggtcactct

SEQ ID NO: 537302 - DNA, 495 bp, Homo sapiens
  misc_feature: HIJSMM301A4NLJ.9.1.A01.1.454.light.4.raw
tgatacgtctcacgaccggtgctcgatttagacgtctcatcagggggagctgctcagttaggacccagagggaaccatggaaaccccacgcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 537303 - DNA, 454 bp, Homo sapiens; identical to SEQ ID NO: 535005
  misc_feature: HIJSMM301EU85F.19.86.H09.1.454.light.4.raw

SEQ ID NO: 537304 - DNA, 504 bp, Homo sapiens; identical to SEQ ID NO: 535561
  misc_feature: HIJSMM301AD1QU.4.57.F02.1.454.light.4.raw

SEQ ID NO: 537305 - DNA, 479 bp, Homo sapiens; identical to SEQ ID NO: 535665
  misc_feature: HIJSMM301DSKDU.12.10.A10.1.454.light.4.raw

SEQ ID NO: 537306 - DNA, 495 bp, Homo sapiens
  misc_feature: HIJSMM301CSCVX.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtggacatccagatgacccagactccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcat

SEQ ID NO: 537307 - DNA, 473 bp, Homo sapiens
  misc_feature: HIJSMM301BFQ60.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttactttgtcaacaggctcagagtttcccgctcactttcggcggagggaccaaggtggagatcaaacgaactgtgg

SEQ ID NO: 537308 - DNA, 441 bp, Homo sapiens
  misc_feature: HIJSMM301B13K4.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaagttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 537309 - DNA, 504 bp, Homo sapiens; identical to SEQ ID NO: 535561
  misc_feature: HIJSMM301EO992.4.57.F02.1.454.light.4.raw

SEQ ID NO: 537310 - DNA, 486 bp, Homo sapiens
  misc_feature: HIJSMM301AJ4RU.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcatt

SEQ ID NO: 537311 - DNA, 506 bp, Homo sapiens
  misc_feature: HIJSMM301DU5E6.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtaccccctccacttcggtcgggacggaacgaacgacggacgatacacgaacgaacctaggtggcgtcgcaccaactcttcgtcttctt

SEQ ID NO: 537312 - DNA, 499 bp, Homo sapiens; identical to SEQ ID NO: 536875
  misc_feature: HIJSMM301CNDUL.51.26.C04.1.454.light.4.raw

SEQ ID NO: 537313 - DNA, 486 bp, Homo sapiens; identical to SEQ ID NO: 535043
  misc_feature: HIJSMM301D9TZA.46.35.D02.1.454.light.4.raw

SEQ ID NO: 537314 - DNA, 492 bp, Homo sapiens
  misc_feature: HIJSMM301DJB4U.14.53.E09.1.454.light.4.raw
cgtctagtaccacgaccggtgctcgatttagagagagtgtgttgggtttggggggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggt

SEQ ID NO: 537315 - DNA, 495 bp, Homo sapiens
  misc_feature: HIJSMM301EKNAA.43.49.E05.1.454.light.4.raw
tgtgagtagtcacgaccggtgctcgatttagagcgactagcaacacacaaaggggaagagctgctcagttaggacccagagggaaccatggaaaccccagcgcagcttctcttcctcctgctactctggctcccagataccaccggagaaattgtgttgacgcagtctccaggcaccgtgtctttgtctccaggggaaagagccaccttctcttgcagggccagtcagagtgttagcagcaactacttagcctggtaccagcagaaacctggccaggctcccaggctcctcatctatggtgcatccaccagggccactggcatcccagacagattcagtggcactgggtctgggacagacttcactctcaccatcagcagactggaacctgaagattttgcaatttattactgtcagcagtatgcctggtcgcctccggccctcactttcggcggagggaccaaggtggagatcaaacgaactgtggctgcacca

SEQ ID NO: 537316 - DNA, 383 bp, Homo sapiens; identical to SEQ ID NO: 447524
  misc_feature: HIJSMM301DC9HW.41.26.C04.1.454.light.4.raw

SEQ ID NO: 537317 - DNA, 494 bp, Homo sapiens; identical to SEQ ID NO: 534994
  misc_feature: HIJSMM301E1OP3.27.78.H01.1.454.light.4.raw

SEQ ID NO: 537318 - DNA, 525 bp, Homo sapiens
  misc_feature: HIJSMM301COUL8.19.85.H08.1.454.light.4.raw
  modified_base (477)..(477): a, c, t, g, unknown or other
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctccaaactcctgtcgtacaggaatgacaaccggccctcaaacatttcagagagattttctacctccaggacacaaaatacagcctctctgaccattactggtctccagcctgacgacgaggctgactactactgctcagcctcgggacgaccacgcctccgctgcttggcgttttcggttccggaagggaccgaacgacngacgtccctggtcgagacccgacgacgtcgccccgtcccgtccgtacc

SEQ ID NO: 537319 - DNA, 486 bp, Homo sapiens; identical to SEQ ID NO: 536329
  misc_feature: HIJSMM301CZK7Q.21.4.A04.1.454.light.4.raw

SEQ ID NO: 537320 - DNA, 485 bp, Homo sapiens; identical to SEQ ID NO: 536630
  misc_feature: HIJSMM301DBX69.13.56.F01.1.454.light.4.raw

SEQ ID NO: 537321 - DNA, 493 bp, Homo sapiens; identical to SEQ ID NO: 536471
  misc_feature: HIJSMM301BKRWG.3.71.G05.1.454.light.4.raw

SEQ ID NO: 537322 - DNA, 504 bp, Homo sapiens
  misc_feature: HIJSMM301A4K7P.48.71.G05.1.454.light.4.raw
agtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttcccg

SEQ ID NO: 537323 - DNA, 484 bp, Homo sapiens
  misc_feature: HIJSMM301BC7U3.13.59.F04.1.454.light.4.raw
  modified_base (239)..(239): a, c, t, g, unknown or other
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacncttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtggctgca

SEQ ID NO: 537324 - DNA, 493 bp, Homo sapiens
  misc_feature: HIJSMM301BDBFZ.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggtacctcgtccgaacggaccgacggtaggaaatacaaacgaactagtggtcgtgcaccatcttcg

SEQ ID NO: 537325 - DNA, 512 bp, Homo sapiens
  misc_feature: HIJSMM301AN2R7.48.86.H09.1.454.light.4.raw
agtatacatacacgaccggtgctcgatttagtgctatagacttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccgccct

SEQ ID NO: 537326 - DNA, 486 bp, Homo sapiens
  misc_feature: HIJSMM301B935D.43.36.D03.1.454.light.4.raw
tgtgagtagtcacgaccggtgctcgatttagctgcgtcacgatctctcttgggggctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaa

SEQ ID NO: 537327 - DNA, 491 bp, Homo sapiens
  misc_feature: HIJSMM301B23HR.43.28.C06.1.454.light.4.raw
tgtgagtagtcacgaccggtgctcgatttagagctcacgtattgggtttgggggatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtactggaggcacctacttgagttggtttcaccagaggccaggccaatctccaaggcgtctgatttataagatttctatccgggactctggggtcccagacaggttcagcggcagtgggtcagacactgacttcacactgagaatcagcagggtggaggctgaggatgttggaatttattactgcatgcaatcttcacactggcctccgtacacttttggccagggaccaagctggagatcaaacgaactgtgg

SEQ ID NO: 537328 - DNA, 489 bp, Homo sapiens
  misc_feature: HIJSMM301DQZ2I.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgt

SEQ ID NO: 537329 - DNA, 488 bp, Homo sapiens
  misc_feature: HIJSMM301AM16H.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccagggaccaaggtggaagtcaagcgaactgtggctgcaccatctgtt

SEQ ID NO: 537330 - DNA, 446 bp, Homo sapiens
  misc_feature: HIJSMM301DRL19.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgcctcctccatactcgta

SEQ ID NO: 537331 - DNA, 489 bp, Homo sapiens; identical to SEQ ID NO: 535091
  misc_feature: HIJSMM301ASCDN.47.36.D03.1.454.light.4.raw

SEQ ID NO: 537332 - DNA, 494 bp, Homo sapiens
  misc_feature: HIJSMM301A9XKK.16.75.G09.1.454.light.4.raw
tgtactactccacgaccggtgctcgatttagtatagacatcagggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgtaggtcgttataactatgtctcctggtaccaacaacacccaggcaacgcccccaggctcatgatttatgaggtcaatgatcggccctcaggaatttccaatcgcttctctggctccaagtctggcaacacggcctccctgacaatctctgacctccagcctgaggacgaggctgaatattactgcagttcatatacaactaagagtcttgtggtattcggcggagggaccaagctgacagtcctaggtcagcccaaggctgccccctc

SEQ ID NO: 537333 - DNA, 487 bp, Homo sapiens
  misc_feature: HIJSMM301AGFMR.52.68.G02.1.454.light.4.raw
cgcagtacgacacgaccggtgctcgatttagtcgatagtgaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggcaaatatttaaattggtatcagcagaaaccagggaaagcccctagactcctgatctatgctgcctccaatttgcaaagtggcgtcccatcgaggttcagtggccgggatctgggacagacttcactctcaccatcagcggtcttcaacctgaggactttggaacttactactgtcagcagagtgataatacccctcagactttcggccctgggactacagtggatgtcaaacgaactgtggctgcaccatctgtt

SEQ ID NO: 537334 - DNA, 513 bp, Homo sapiens
  misc_feature: HIJSMM301AL57C.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctggtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgccctcctca

SEQ ID NO: 537335 - DNA, 487 bp, Homo sapiens; identical to SEQ ID NO: 537220
  misc_feature: HIJSMM301EI0BG.16.53.E09.1.454.light.4.raw

SEQ ID NO: 537336 - DNA, 518 bp, Homo sapiens
  misc_feature: HIJSMM301AIUWR.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcagggtcagcccaaggctgccccctcggtcactctgttcccgcctcctccacg

SEQ ID NO: 537337 - DNA, 495 bp, Homo sapiens
  misc_feature: HIJSMM301ATISL.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggacttcggccctggaccaaagtaggagatcaaacgaactagtggctgcaccactctgtctt

SEQ ID NO: 537338 - DNA, 493 bp, Homo sapiens
  misc_feature: HIJSMM301AGT96.27.78.H01.1.454.light.4.raw
agcgtcgtctcacgaccggtgctcgatttagtgtgagtagtttgggtttgggggcatgagcaaaactagacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaaggacacgactggagattaaacgaactgtggctgcaccatctgt

SEQ ID NO: 537339 - DNA, 502 bp, Homo sapiens
  misc_feature: HIJSMM301DN44L.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggt

SEQ ID NO: 537340 - DNA, 487 bp, Homo sapiens
  misc_feature: HIJSMM301AQEN7.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatacaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattatacttcgtggacgttcggccaagggaccaaggtggatatcagacgaa

SEQ ID NO: 537341 - DNA, 514 bp, Homo sapiens
  misc_feature: HIJSMM301CFEEQ.9.20.B09.1.454.light.4.raw
tgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatcacccccgtgttcggcgggggaccaagctgaccgtcctaggtcagcccaaggctgccccctcggtcactctgttcccaccctcctcagacgtatca

SEQ ID NO: 537342 - DNA, 502 bp, Homo sapiens
  misc_feature: HIJSMM301EKEK2.49.43.D10.1.454.light.4.raw
agtcgagagacacgaccggtgctcgatttagactagcagtaaggggagagaagacaggactcaggacaatctccagcatggccagcttccctctcctcctcaccctcctcactcactgtgcagggtcctgggcccagtctgtgctgactcagccaccctcagcgtctgggactcccgggcagagggtcaccatctcttgttctggaggcagctccaacatcggaagtaatgatgttaactggtaccaacaaattccaggacggccccaatgtcttcatctttggtaatgatcagcggccctcaggggtccctgaccgattctctggctccaagtctggcacctcagcctccctggccatcagtgggctccagtctgaggatgaggctgattattactgtgcaacatgggatgacagcctgaatgccgtggttttcggcggagggaccaaggtgaccgtcctaggtcagcccaaggctgccccctcggtcactctgttcccta

SEQ ID NO: 537343 - DNA, 502 bp, Homo sapiens
  misc_feature: HIJSMM301EM3R8.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaacgtggatatcaaacgaactgtggctgcaccatct

SEQ ID NO: 537344 - DNA, 496 bp, Homo sapiens
  misc_feature: HIJSMM301DLIRR.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagtgattctctggctccaggtcagggacaacagtcacgttgaccatcagtggagtccaggcagaagacgaggctgactattactgtcaatcagcagacagcagtggtacttttcgggttttcggcggaggaccaagctgaccgtcctaggtcagcccaaggctgccccctcggt

SEQ ID NO: 537345 - DNA, 489 bp, Homo sapiens; identical to SEQ ID NO: 535386
  misc_feature: HIJSMM301EBQYA.12.51.E07.1.454.light.4.raw

SEQ ID NO: 537346 - DNA, 492 bp, Homo sapiens
  misc_feature: HIJSMM301CYC9G.4.75.G09.1.454.light.4.raw
agcactgtagcacgaccggtgctcgatttagtatagacatcagggggagctacaacaggcaggcaggggcagcaagatggtgttgcagacccaggtcttcatttctctgttgctctggatctctggtgcctacggggacatcgtgctgacccagtctccagactccctggctgtgtctctgggcgagagggccaccatcaactgcaagtccagccagagtgttttatacagctccaataataagaattatttaggttggtaccagcagaaaccagggcagcctcctaaactgctcatttactgggcatctacccgggaatccggggtccctgaccgattcactggcagcgggtctgggacagatttcactctcacgatcagcagcctgcaggctgaagatgtggcagtttatactgtcaacagtattataatagtccgatcaccttcggccaagggacacgactggagattaaacgaactgtggctgcacca

SEQ ID NO: 537347 - DNA, 454 bp, Homo sapiens; identical to SEQ ID NO: 534964
  misc_feature: HIJSMM301EMO4O.19.86.H09.1.454.light.4.raw

SEQ ID NO: 537348 - DNA, 481 bp, Homo sapiens; identical to SEQ ID NO: 535993
  misc_feature: HIJSMM301A8MWR.21.25.C03.1.454.light.4.raw

SEQ ID NO: 537349 - DNA, 479 bp, Homo sapiens
  misc_feature: HIJSMM301A8VKG.48.28.C06.1.454.light.4.raw
agtatacatacacgaccggtgctcgatttagagctcacgtattgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagacccg

SEQ ID NO: 537350 - DNA, 494 bp, Homo sapiens; identical to SEQ ID NO: 535828
  misc_feature: HIJSMM301BM3C0.3.36.D03.1.454.light.4.raw

SEQ ID NO: 537351 - DNA, 474 bp, Homo sapiens
  misc_feature: HIJSMM301CGGCP.3.1.A01.1.454.light.4.raw
agacgcactccacgaccggtgctcgatttagacgtctcatcagggggagtcagactcagtcaggacacagcatggacatgttggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactgtggctgcaccat

SEQ ID NO: 537352 - DNA, 484 bp, Homo sapiens; identical to SEQ ID NO: 536162
  misc_feature: HIJSMM301B0QDW.13.59.F04.1.454.light.4.raw

SEQ ID NO: 537353 - DNA, 496 bp, Homo sapiens; identical to SEQ ID NO: 535109
  misc_feature: HIJSMM301EC4QZ.16.78.H01.1.454.light.4.raw

SEQ ID NO: 537354 - DNA, 484 bp, Homo sapiens
  misc_feature: HIJSMM301A8DZW.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccaccctcctctacgtgagct

SEQ ID NO: 537355 - DNA, 484 bp, Homo sapiens
  misc_feature: HIJSMM301CHI9Z.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatacaagcaacacactggccgtacacttttggccagggaccaagctggagatcaatcgaactgtgg

SEQ ID NO: 537356 - DNA, 490 bp, Homo sapiens; identical to SEQ ID NO: 535420
  misc_feature: HIJSMM301CKKNU.3.72.G06.1.454.light.4.raw

SEQ ID NO: 537357 - DNA, 488 bp, Homo sapiens
  misc_feature: HIJSMM301AR5SQ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 537358 - DNA, 492 bp, Homo sapiens; identical to SEQ ID NO: 536010
  misc_feature: HIJSMM301BJXZ9.10.20.B09.1.454.light.4.raw

SEQ ID NO: 537359 - DNA, 478 bp, Homo sapiens; identical to SEQ ID NO: 535129
  misc_feature: HIJSMM301AZZY6.11.11.A11.1.454.light.4.raw

SEQ ID NO: 537360 - DNA, 482 bp, Homo sapiens; identical to SEQ ID NO: 535920
  misc_feature: HIJSMM301ENAIL.19.71.G05.1.454.light.4.raw

SEQ ID NO: 537361 - DNA, 485 bp, Homo sapiens
  misc_feature: HIJSMM301BP7G2.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgacgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccgggggacacggctggaactaaacgaactgtggctgcacca

SEQ ID NO: 537362 - DNA, 382 bp, Homo sapiens
  misc_feature: HIJSMM301A6TOJ.41.34.D01.1.454.light.4.raw
tctatactatcacgaccggtgctcgatttagatcgtctgtgttgggtttggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 537363 - DNA, 502 bp, Homo sapiens
  misc_feature: HIJSMM301DUOI4.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaatttcccgctcactttcggcggagggaccaaggtggagatcaaacgaactgtggctgcaccatctgtcttcatcttccccg

SEQ ID NO: 537364 - DNA, 493 bp, Homo sapiens; identical to SEQ ID NO: 535770
  misc_feature: HIJSMM301CR8Q0.51.71.G05.1.454.light.4.raw

SEQ ID NO: 537365 - DNA, 423 bp, Homo sapiens
  misc_feature: HIJSMM301A175L.41.15.B04.1.454.light.4.raw
tctatactatcacgaccggtgctcgatttagacagtatatatccgcgggcgacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 537366 - DNA, 495 bp, Homo sapiens
  misc_feature: HIJSMM301CMN3A.5.24.C02.1.454.light.4.raw
atcagacacgcacgaccggtgctcgatttagtacagatcgttagggaaaggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagccc

SEQ ID NO: 537367 - DNA, 505 bp, Homo sapiens
  misc_feature: HIJSMM301DFAF1.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagattttactctcaccatcagcagcctgcaggctgaagatgtggcagtttattactgtcaacagttttctcgggcgttcggccaagggaccaaggtggaaagtacaaacgaactagtggctgcaccatctgtcttcatcttcccgt

SEQ ID NO: 537368 - DNA, 476 bp, Homo sapiens
  misc_feature: HIJSMM301DUMP3.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagcctccctgaccattactggactccagcctgaggacgaggctgactattactgctcagcatgggacagcagcctccgtggtgtggtgatcggcggagggaccaggctgaccgtcct

SEQ ID NO: 537369 - DNA, 487 bp, Homo sapiens; identical to SEQ ID NO: 536708
  misc_feature: HIJSMM301CKARU.4.64.F09.1.454.light.4.raw

SEQ ID NO: 537370 - DNA, 444 bp, Homo sapiens; identical to SEQ ID NO: 534993
  misc_feature: HIJSMM301D1AEU.5.9.A09.1.454.light.4.raw

SEQ ID NO: 537371 - DNA, 483 bp, Homo sapiens
  misc_feature: HIJSMM301D5OYD.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaactgtggctgcaccatctgtcttcta

SEQ ID NO: 537372 - DNA, 464 bp, Homo sapiens; identical to SEQ ID NO: 535417
  misc_feature: HIJSMM301DIXSW.11.73.G07.1.454.light.4.raw

SEQ ID NO: 537373 - DNA, 482 bp, Homo sapiens
  misc_feature: HIJSMM301DTR1Z.47.70.G04.1.454.light.4.raw
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtacccgtacacttttggccaggggacaaactggacatcaacgaactgtgctgcaccatctgt

SEQ ID NO: 537374 - DNA, 504 bp, Homo sapiens
  misc_feature: HIJSMM301BKBBN.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacacttggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacg

SEQ ID NO: 537375 - DNA, 515 bp, Homo sapiens
  misc_feature: HIJSMM301BUB1D.16.88.H11.1.454.light.4.raw
tgtactactccacgaccggtgctcgatttagcgacagcgagaacacgacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcggtgcgcagcctgaggatgaggctgagtattactgcttgctctcctatagtggtgttcgggtgttcggcggagggaccaagctgaccgtcctaggtcagcccaaggctgccccctcggtcactctgttcccaccct

SEQ ID NO: 537376 - DNA, 498 bp, Homo sapiens
  misc_feature: HIJSMM301EI52M.10.65.F10.1.454.light.4.raw
catagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggcggagggaccaaggtggagatcaaacgaactgtggctgcaccatctgtcttcatcttcccgtcca

SEQ ID NO: 537377 - DNA, 485 bp, Homo sapiens; identical to SEQ ID NO: 536582
  misc_feature: HIJSMM301A80IE.3.46.E02.1.454.light.4.raw

SEQ ID NO: 537378 - DNA, 492 bp, Homo sapiens
  misc_feature: HIJSMM301AF3XF.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtggacatcaagcgaactagtggctgcaccatctgtt

SEQ ID NO: 537379 - DNA, 501 bp, Homo sapiens
  misc_feature: HIJSMM301B801Y.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagatactactttacctcaagtgatcaccttcggccaagggacacgactggagattaaacg

SEQ ID NO: 537380 - DNA, 475 bp, Homo sapiens
  misc_feature: HIJSMM301BMU16.5.28.C06.1.454.light.4.raw
atcagacacgcacgaccggtgctcgatttagagctcacgtattgggtttggggactttccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccaaggtggagatcgaacgaactgtggctgcaccatctgtcttcatcttcccgccatctgacgt

SEQ ID NO: 537381 - DNA, 490 bp, Homo sapiens
  misc_feature: HIJSMM301EWULV.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggaggatcaaacgaact

SEQ ID NO: 537382 - DNA, 493 bp, Homo sapiens; identical to SEQ ID NO: 537281
  misc_feature: HIJSMM301C8MCG.9.1.A01.1.454.light.4.raw

SEQ ID NO: 537383 - DNA, 477 bp, Homo sapiens
  misc_feature: HIJSMM301BLZNY.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaagggaaagtaatgaagttaacactgtggatcaccttcggccaagggacacgactggagattaaacgaactgtggctgcaccatctgtcttcatcttcccgccatctgaagtatagtct

SEQ ID NO: 537384 - DNA, 497 bp, Homo sapiens; identical to SEQ ID NO: 537300
  misc_feature: HIJSMM301C13CE.9.53.E09.1.454.light.4.raw

SEQ ID NO: 537385 - DNA, 481 bp, Homo sapiens
  misc_feature: HIJSMM301BHRE7.52.4.A04.1.454.light.4.raw
cgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacagaagcactctggtgttcggcggagggaccaggctgaccgtcctaggtcagcccaaggctgccccccg

SEQ ID NO: 537386 - DNA, 463 bp, Homo sapiens; identical to SEQ ID NO: 535062
  misc_feature: HIJSMM301DYMUA.11.73.G07.1.454.light.4.raw

SEQ ID NO: 537387 - DNA, 452 bp, Homo sapiens
  misc_feature: HIJSMM301ARRGZ.3.38.D05.1.454.light.4.raw
agacgcactccacgaccggtgctcgatttagtatctgatagttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcacttcggcggggacggacgagg

SEQ ID NO: 537388 - DNA, 484 bp, Homo sapiens
  misc_feature: HIJSMM301CLJM9.15.28.C06.1.454.light.4.raw
tctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcgagggaccaaggtggagatcaaacgaactgtggctgcaccatctgtcttcatt

SEQ ID NO: 537389 - DNA, 499 bp, Homo sapiens
  misc_feature: HIJSMM301AEINM.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccgagggtggaaagtacaaacgaactagtggctgcaccatctgtcttcatt

SEQ ID NO: 537390 - DNA, 483 bp, Homo sapiens; identical to SEQ ID NO: 535256
  misc_feature: HIJSMM301BH2BN.47.60.F05.1.454.light.4.raw

SEQ ID NO: 537391 - DNA, 496 bp, Homo sapiens
  misc_feature: HIJSMM301D937Y.51.7.A07.1.454.light.4.raw
cgatcgtatacacgaccggtgctcgatttagcacgtgtcgcaggggtccaaacagagcttcagcaagcatagtgggaatctgcaccatgccctgggctctgctcctcctgaccctcctcactcactctgcagtgtcagtggtcccggcaggactgacgcagccaccctcggtgtccaagggcttgagacagaccgccacactcacctgcattgggaactactacaatgtgggcgaccaaggaacactttggctgcagcagtaccagggccaccctcccaaactcctgtcctacagggataatacccggccctcagggatctcagagagattctcagcttccacgtcaggatacacagcctccctgaccattactggactccagcctggggacgaggctgactattactgctcagcgtgggacagcagcctcagagcttgggtgttcggcggagggaccaggctgaccgtcctgagtcagcccaaggctgccccccg

SEQ ID NO: 537392 - DNA, 445 bp, Homo sapiens; identical to SEQ ID NO: 537075
  misc_feature: HIJSMM301AGG7C.5.9.A09.1.454.light.4.raw

SEQ ID NO: 537393 - DNA, 504 bp, Homo sapiens
  misc_feature: HIJSMM301APV80.15.25.C03.1.454.light.4.raw
tctacgtagccacgaccggtgctcgatttagtagtgtagatttgggtttgggggatcaggactcctcagttcaccttctcacaatgaggctccctgctcagctcctggggcgtgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagatttttacactgaaaatcagcagagtggaggctgaggacgttggggtttagttactgcatggcaaggtctacaaaaccccgatcaccttcggccgagggacacgcctggagattaaacgaactagtggctgcaccat

SEQ ID NO: 537394 - DNA, 485 bp, Homo sapiens; identical to SEQ ID NO: 535688
  misc_feature: HIJSMM301CF16L.19.5.A05.1.454.light.4.raw

SEQ ID NO: 537395 - DNA, 492 bp, Homo sapiens
  misc_feature: HIJSMM301BP3IJ.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttcccgccta

SEQ ID NO: 537396 - DNA, 490 bp, Homo sapiens; identical to SEQ ID NO: 535234
  misc_feature: HIJSMM301APW1M.17.21.B10.1.454.light.4.raw

SEQ ID NO: 537397 - DNA, 527 bp, Homo sapiens
  misc_feature: HIJSMM301BQH5Y.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaagggaccgaacggtaggaaggtacgtaaacgaaccgtaagtggcgtgcgaccaactcctgttcttctatcttcccgtcccact

SEQ ID NO: 537398 - DNA, 502 bp, Homo sapiens; identical to SEQ ID NO: 537363
  misc_feature: HIJSMM301AZZQT.18.23.C01.1.454.light.4.raw

SEQ ID NO: 537399 - DNA, 484 bp, Homo sapiens
  misc_feature: HIJSMM301DZ7J6.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaacttcggccaggggacacgactggagattaaacgaactgtggctgcaccatctgt

SEQ ID NO: 537400 - DNA, 494 bp, Homo sapiens
  misc_feature: HIJSMM301A9351.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacgatcccaggatgacccagtcgtccagtcctacccgtgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacgggtacccctacacttttggccaggggaccaaactggacatcaaacgaactgtggctgcaccatctgt

SEQ ID NO: 537401 - DNA, 504 bp, Homo sapiens
  misc_feature: HIJSMM301BMD0Q.51.23.C01.1.454.light.4.raw
cgatcgtatacacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagatcaaacgaactgtggctgcaccatctgtcttcatcttcccgccat

SEQ ID NO: 537402 - DNA, 482 bp, Homo sapiens
  misc_feature: HIJSMM301CQLJD.10.53.E09.1.454.light.4.raw
catagtagtgcacgaccggtgctcgatttagagagagtgtgttgggtttggggacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtacccccattcacattcggccctgggaccaaagtggagatcaaacgaa

SEQ ID NO: 537403 - DNA, 489 bp, Homo sapiens
  misc_feature: HIJSMM301BQALR.51.33.C11.1.454.light.4.raw
cgatcgtatacacgaccggtgctcgatttagagtgagctcgttgggtttgggggaggaactgctcagttaggacccagagggaaccatggaagccccagctcagcttctcttcctcctgctactctggctcccagattccaccggagaaattgtgttgacacagtctccaggcaccctgtctttgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgtggctgcaccat

SEQ ID NO: 537404 - DNA, 506 bp, Homo sapiens
  misc_feature: HIJSMM301CUCY5.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggccctgggaccgaaatggagatcaaacgaactgtggctgcaccatctgtcttcta

SEQ ID NO: 537405 - DNA, 504 bp, Homo sapiens
  misc_feature: HIJSMM301CXNRP.51.46.E02.1.454.light.4.raw
cgatcgtatacacgaccggtgctcgatttagactcatctacagggaaagggggatcaggactcctcagttcaccctctcacaatgaggctccctgctcagctcctggggctgctaatgctctgggtcccaggatgcagtggggctgttgtgatgactcagtctccactctccctgcccgtcacccttggacagccggcctccatctcctgcaggtctagtcaaggcctcgtttatagtgatggagacacctacttgagttggtttcaccagaggccaggccaatctccaaggcgcctaatttataaggtttctaaccgggactctggggtcccagacaaattcagcggcagtgggtcaggcactgatttcacactgaaaatcagcagggtggaggctgaggatgttgggatttactactgtatgcaaggtacacactggcctctcactttcggcggagggaccaaggtggagatgaaacgaactgtggctgcaccatctgtctt

SEQ ID NO: 537406 - DNA, 489 bp, Homo sapiens; identical to SEQ ID NO: 535386
  misc_feature: HIJSMM301AY33E.12.51.E07.1.454.light.4.raw

SEQ ID NO: 537407 - DNA, 485 bp, Homo sapiens; identical to SEQ ID NO: 536040
  misc_feature: HIJSMM301CZAEH.15.1.A01.1.454.light.4.raw

SEQ ID NO: 537408 - DNA, 488 bp, Homo sapiens
  misc_feature: HIJSMM301A18B3.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccaggggaccaagctggagatcacaggaactgtggctgcaccat

SEQ ID NO: 537409 - DNA, 499 bp, Homo sapiens
  misc_feature: HIJSMM301EC3EV.51.15.B04.1.454.light.4.raw
cgatcgtatacacgaccggtgctcgatttagacagtatatatccgcggggcgggtgggggcacttctccctctaacactctcccctgctaatgctctgggtctctggatccagtggggatattgtgatgactcagtctccactctccctgcccgtcacccctggagagccggcctccatctcctgcaggtctagtcagagcctcctccatagtaatggattcagctatttggattggtacctgcagaggccagggcagtctccacagctcctgatctatttgggttctaatcgggccccggggtccctgacaggttcagtggcagtggatcaggcacagattttacactgaaaatcagcagcgtggaggctgaggatgttggggtttattactgcatgcaagctctacaaactcctacgttcggccaagggaccaaggtggaaatcaaacgaactgtggctgcaccatctgtcttcatcttcccgccatctgatcgtag

SEQ ID NO: 537410 - DNA, 447 bp, Homo sapiens; identical to SEQ ID NO: 535201
  misc_feature: HIJSMM301D1ANQ.18.9.A09.1.454.light.4.raw

SEQ ID NO: 537411 - DNA, 479 bp, Homo sapiens; identical to SEQ ID NO: 535188
  misc_feature: HIJSMM301CDJQ2.10.74.G08.1.454.light.4.raw

SEQ ID NO: 537412 - DNA, 477 bp, Homo sapiens
  misc_feature: HIJSMM301CFVSB.12.1.A01.1.454.light.4.raw
atacgacgtacacgaccggtgctcgatttagacgtctcatcagggcacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgcca

SEQ ID NO: 537413 - DNA, 447 bp, Homo sapiens; identical to SEQ ID NO: 535020
  misc_feature: HIJSMM301EGVCQ.18.9.A09.1.454.light.4.raw

SEQ ID NO: 537414 - DNA, 483 bp, Homo sapiens
  misc_feature: HIJSMM301A88HW.5.12.B01.1.454.light.4.raw
atcagacacgcacgaccggtgctcgatttagtagtgtagattccgcgggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagcccaaggctgcccctccggtcgactctgttcccgccctcctccgtcgtctcgagt

SEQ ID NO: 537415 - DNA, 495 bp, Homo sapiens
  misc_feature: HIJSMM301AW0JL.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtcactc

SEQ ID NO: 537416 - DNA, 505 bp, Homo sapiens
  misc_feature: HIJSMM301BKQO9.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaaccacacacggccgctcactttcggcggagggaccaaggtggagatcaaacgaactgtggctgcaccatctgt

SEQ ID NO: 537417 - DNA, 498 bp, Homo sapiens
  misc_feature: HIJSMM301CNN5X.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactagtggctgcaccatctgtcttctcttccccg

SEQ ID NO: 537418 - DNA, 494 bp, Homo sapiens
  misc_feature: HIJSMM301CLZMI.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagtcaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 537419 - DNA, 354 bp, Homo sapiens; identical to SEQ ID NO: 535026
  misc_feature: HIJSMM301B5B1Y.19.22.B11.1.454.light.4.raw

SEQ ID NO: 537420 - DNA, 507 bp, Homo sapiens
  misc_feature: HIJSMM301BFXBI.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccgaagggaccaaggtggaaatacaaacgaactagtggctgcaccatctgtcttcatcttccccg

SEQ ID NO: 537421 - DNA, 350 bp, Homo sapiens
  misc_feature: HIJSMM301D7394.13.11.A11.1.454.light.4.raw
tcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgccatctgatagtacgtga

SEQ ID NO: 537422 - DNA, 493 bp, Homo sapiens
  misc_feature: HIJSMM301BFMKA.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtccg

SEQ ID NO: 537423 - DNA, 506 bp, Homo sapiens; identical to SEQ ID NO: 536355
  misc_feature: HIJSMM301DHIJP.47.85.H08.1.454.light.4.raw

SEQ ID NO: 537424 - DNA, 482 bp, Homo sapiens
  misc_feature: HIJSMM301DWWXS.4.39.D06.1.454.light.4.raw
agcactgtagcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttcggccaggggaccaaggtcgaaatgagacgaactgtggctgcaccatctgtt

SEQ ID NO: 537425 - DNA, 504 bp, Homo sapiens
  misc_feature: HIJSMM301D1PBC.40.26.C04.1.454.light.4.raw
tctagcgactcacgaccggtgctcgatttagtctagcgactttgggtttgggggagctgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgccat

SEQ ID NO: 537426 - DNA, 489 bp, Homo sapiens
  misc_feature: HIJSMM301AY84U.16.72.G06.1.454.light.4.raw
tgtactactccacgaccggtgctcgatttagctacgactgcaagggaaagggggaggaactgctcagttaggacccagacggaaccatggaagccccagcgcagcttcacttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtggagatcaaacgaactgtggctgcaccat

SEQ ID NO: 537427 - DNA, 484 bp, Homo sapiens
  misc_feature: HIJSMM301AH0G5.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgagggtggagatcagacgaa

SEQ ID NO: 537428 - DNA, 486 bp, Homo sapiens
  misc_feature: HIJSMM301DURVR.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggaccaaagtggatatcaaacgaactgtggctgcaccatctgtt

SEQ ID NO: 537429 - DNA, 494 bp, Homo sapiens; identical to SEQ ID NO: 534992
  misc_feature: HIJSMM301DFTC8.9.1.A01.1.454.light.4.raw

SEQ ID NO: 537430 - DNA, 504 bp, Homo sapiens
  misc_feature: HIJSMM301BR1VI.12.53.E09.1.454.light.4.raw
atacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtcactctgttcccaccctcctctacgtcgtat

SEQ ID NO: 537431 - DNA, 490 bp, Homo sapiens
  misc_feature: HIJSMM301DFGA8.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccactttggtccaggggaccgaagctggaggatcaggcgaacg

SEQ ID NO: 537432 - DNA, 494 bp, Homo sapiens; identical to SEQ ID NO: 534992
  misc_feature: HIJSMM301BYF29.9.1.A01.1.454.light.4.raw

SEQ ID NO: 537433 - DNA, 421 bp, Homo sapiens
  misc_feature: HIJSMM301A0KFG.9.34.D01.1.454.light.4.raw
tgatacgtctcacgaccggtgctcgatttagatcgtctgtgttgggtttggggctgttctggagttgttggtaccagaggtcaccatctcgtgcactggaagtagctccaacagtcggggcacgttatgatgtacactggtaccaacaacttccaggaacacgacccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccaccctcctcagacgtatca

SEQ ID NO: 537434 - DNA, 484 bp, Homo sapiens
  misc_feature: HIJSMM301CUX20.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcgagggaccaaggtggagatcaaacgaac

SEQ ID NO: 537435 - DNA, 488 bp, Homo sapiens; identical to SEQ ID NO: 536554
  misc_feature: HIJSMM301EUEVC.26.37.D04.1.454.light.4.raw

SEQ ID NO: 537436 - DNA, 487 bp, Homo sapiens
  misc_feature: HIJSMM301ED56C.49.45.E01.1.454.light.4.raw
agtcgagagacacgaccggtgctcgatttagtgagtcagtaagggaaagggcacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccgggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcatcttccgccatctgat

SEQ ID NO: 537437 - DNA, 512 bp, Homo sapiens
  misc_feature: HIJSMM301EJ912.7.34.D01.1.454.light.4.raw
cgtgtctctacacgaccggtgctcgatttagatcgtctgtgttgggtttgggggggtcgtcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagtccaaggctgccccctcggtcactc

SEQ ID NO: 537438 - DNA, 496 bp, Homo sapiens
  misc_feature: HIJSMM301DY2CI.19.71.G05.1.454.light.4.raw
tactctcgtgcacgaccggtgctcgatttagtgtcgtcgcaagagagaggggggaggtacaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctg

SEQ ID NO: 537439 - DNA, 485 bp, Homo sapiens
  misc_feature: HIJSMM301AF1PV.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccagggacgacgactggagattaaacgaactgtggctgcaccatctgt

SEQ ID NO: 537440 - DNA, 498 bp, Homo sapiens
  misc_feature: HIJSMM301CBCFS.41.3.A03.1.454.light.4.raw
tctatactatcacgaccggtgctcgatttagagagcgtcacagggaagagctgctcagttaggacccagagggaaccatggaaaccccagcgcagcttctcttcctcctgctactctggctcccaggtgccaccggagaaattgtgttgacgcagtctccaggcaccctgtctttctctccaggggaaagagccaccctctcctgcagggccagtcagagtgttgacaaccagtacttcgcctggtaccagcagaaacctggccaggctcccaggctcctcatggatggtgcatccagcagggccactggcatcccagacaggttcggtggcagtgggtctgggacagacttcactctcaccatcagcagcctggagcctgaagattttgtagtgtattactgtcagcagtatcttacaacaccggggagttttggccaggggaccaagctggagatcaaacgaactgtggctgcaccatctgtcttcatcttccccg

SEQ ID NO: 537441 - DNA, 504 bp, Homo sapiens
  misc_feature: HIJSMM301ALNNP.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaaagctgaccgtcctgggtcagcccaaggctgccccctcggtca

SEQ ID NO: 537442 - DNA, 498 bp, Homo sapiens
  misc_feature: HIJSMM301B3RD2.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggtccgaacggacgacgactacggagaattaaacgaactgtggctgcaccatctgtcttctatt

SEQ ID NO: 537443 - DNA, 487 bp, Homo sapiens; identical to SEQ ID NO: 536206
  misc_feature: HIJSMM301DHYU2.47.38.D05.1.454.light.4.raw

SEQ ID NO: 537444 - DNA, 434 bp, Homo sapiens
  misc_feature: HIJSMM301BLMPE.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggccaggggaccaagctggagatcaaacgaactgtggctgcaccatctgtcttcattttcccgccatctgacatactcgta

SEQ ID NO: 537445 - DNA, 503 bp, Homo sapiens; identical to SEQ ID NO: 537189
  misc_feature: HIJSMM301BJVET.19.85.H08.1.454.light.4.raw

SEQ ID NO: 537446 - DNA, 496 bp, Homo sapiens; identical to SEQ ID NO: 535109
  misc_feature: HIJSMM301DFASI.16.78.H01.1.454.light.4.raw

SEQ ID NO: 537447 - DNA, 496 bp, Homo sapiens
  misc_feature: HIJSMM301EUKDV.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgatttgtcgacttattattgcaacagtataagagtaattctaacttacgtcctcggccgaacgtagtaggatagtagaaactaaactaacgtaaggtacgtgcgaccactact

SEQ ID NO: 537448 - DNA, 485 bp, Homo sapiens; identical to SEQ ID NO: 536263
  misc_feature: HIJSMM301BNUKE.47.78.H01.1.454.light.4.raw

SEQ ID NO: 537449 - DNA, 484 bp, Homo sapiens
  misc_feature: HIJSMM301ASXT9.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttggccaaggaccaaggtggatatcagacgaa

SEQ ID NO: 537450 - DNA, 492 bp, Homo sapiens
  misc_feature: HIJSMM301BWLJX.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggtcggagggaccgaaggacggagatcagacgaactgtggctgcaccatctgtcttcta

SEQ ID NO: 537451 - DNA, 503 bp, Homo sapiens; identical to SEQ ID NO: 536834
  misc_feature: HIJSMM301DV1Y2.2.35.D02.1.454.light.4.raw

SEQ ID NO: 537452 - DNA, 441 bp, Homo sapiens; identical to SEQ ID NO: 534971
  misc_feature: HIJSMM301ANEZM.11.3.A03.1.454.light.4.raw

SEQ ID NO: 537453 - DNA, 477 bp, Homo sapiens
  misc_feature: HIJSMM301EORBG.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtggggtcccatcaaggttcagtggcagtggatctgggacagatttcactctcaccatccgcagtctgcaacctgaagattttgcaatttattactgtcaagagactcacaatggaggcacttttggccaggggaccaagctggagaggaaacgaactgtggctgcaccat

SEQ ID NO: 537454 - DNA, 434 bp, Homo sapiens; identical to SEQ ID NO: 535153
  misc_feature: HIJSMM301DYP0B.18.5.A05.1.454.light.4.raw

SEQ ID NO: 537455 - DNA, 494 bp, Homo sapiens; identical to SEQ ID NO: 534994
  misc_feature: HIJSMM301AJM3A.27.78.H01.1.454.light.4.raw

SEQ ID NO: 537456 - DNA, 502 bp, Homo sapiens
  misc_feature: HIJSMM301C2A2L.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttacctcaagtgatcaccttcggccaagggacacgctaggagattaaacg

SEQ ID NO: 537457 - DNA, 483 bp, Homo sapiens
  misc_feature: HIJSMM301CYU4S.5.39.D06.1.454.light.4.raw
atcagacacgcacgaccggtgctcgatttagtgacatctcgcagttctttggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccgaaggtcgaaatagagacgaactgtggctgcaccat

SEQ ID NO: 537458 - DNA, 472 bp, Homo sapiens; identical to SEQ ID NO: 535584
  misc_feature: HIJSMM301BW5HT.11.17.B06.1.454.light.4.raw

SEQ ID NO: 537459 - DNA, 501 bp, Homo sapiens
  misc_feature: HIJSMM301CIZLB.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcatcttcccgccta

SEQ ID NO: 537460 - DNA, 514 bp, Homo sapiens
  misc_feature: HIJSMM301BLNO6.22.30.C08.1.454.light.4.raw
acatacgcgtcacgaccggtgctcgatttagtctgacgtcaaagggaaagggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggaggaccaagctgaccgtctaggtcagcccaaggctgccccctggtcactctgttcccgccctcctcacg

SEQ ID NO: 537461 - DNA, 471 bp, Homo sapiens
  misc_feature: HIJSMM301A064C.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgaagtgcatatgaagagaactgtgg

SEQ ID NO: 537462 - DNA, 505 bp, Homo sapiens; identical to SEQ ID NO: 535503
  misc_feature: HIJSMM301D9DAL.8.28.C06.1.454.light.4.raw

SEQ ID NO: 537463 - DNA, 489 bp, Homo sapiens
  misc_feature: HIJSMM301AXSJL.41.61.F06.1.454.light.4.raw
tctatactatcacgaccggtgctcgatttagctacgctctaagggaaagggggaggtcagacccacgtcaggacacagcatggacatgagggtccccggcctcagctcctggggcgtcctgctgctctggttcccaggttccagatgcgacatccagatgacccagtctccatcttccgtgtctgcatctgtaggagacagagtcaccatcacttgtcgggcgactcagggtattagcagctggttagcctggtatcagcagaaaccagggaaagcccctaagctcctgatctatgctgcatccagtttgcaaagtggggtcccatcaaggttcagcggcagtggatctggggacagatttcactctcaccatcagcagcctgcagcctgaagattttgcaacttactattgtcaacagggtaacagtttccctctcactttcggcggagggaccaaggtggagatcaaacgaactgtggctgcaccat

SEQ ID NO: 537464 - DNA, 511 bp, Homo sapiens
  misc_feature: HIJSMM301CF3B3.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcact

SEQ ID NO: 537465 - DNA, 494 bp, Homo sapiens
  misc_feature: HIJSMM301DKA23.22.14.B03.1.454.light.4.raw
acatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctcagacgttcggccaagggaccaaggtggaaatcaaacgaactgtggctgcacc

SEQ ID NO: 537466 - DNA, 488 bp, Homo sapiens; identical to SEQ ID NO: 536861
  misc_feature: HIJSMM301CN6TM.12.88.H11.1.454.light.4.raw

SEQ ID NO: 537467 - DNA, 503 bp, Homo sapiens
  misc_feature: HIJSMM301EJGWF.43.42.D09.1.454.light.4.raw
tgtgagtagtcacgaccggtgctcgatttagacacatacgcagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggtcggagggaccgaaggtggagagtcaaacgaactagtggcgtgcaccatctgtcttcta

SEQ ID NO: 537468 - DNA, 506 bp, Homo sapiens; identical to SEQ ID NO: 536355
  misc_feature: HIJSMM301A0JME.47.85.H08.1.454.light.4.raw

SEQ ID NO: 537469 - DNA, 440 bp, Homo sapiens; identical to SEQ ID NO: 535667
  misc_feature: HIJSMM301DR7LI.41.9.A09.1.454.light.4.raw

SEQ ID NO: 537470 - DNA, 504 bp, Homo sapiens
  misc_feature: HIJSMM301EK2WS.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggaggatcaaacgaactgtggctgcaccatct

SEQ ID NO: 537471 - DNA, 507 bp, Homo sapiens; identical to SEQ ID NO: 535930
  misc_feature: HIJSMM301BCGHR.15.34.D01.1.454.light.4.raw

SEQ ID NO: 537472 - DNA, 493 bp, Homo sapiens; identical to SEQ ID NO: 535047
  misc_feature: HIJSMM301AEGUE.16.53.E09.1.454.light.4.raw

SEQ ID NO: 537473 - DNA, 493 bp, Homo sapiens
  misc_feature: HIJSMM301CRI39.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtgagatcaaacgaactgtggctgcaccat

SEQ ID NO: 537474 - DNA, 486 bp, Homo sapiens; identical to SEQ ID NO: 536323
  misc_feature: HIJSMM301CHU7A.10.2.A02.1.454.light.4.raw

SEQ ID NO: 537475 - DNA, 494 bp, Homo sapiens; identical to SEQ ID NO: 534994
  misc_feature: HIJSMM301EK5WB.27.78.H01.1.454.light.4.raw

SEQ ID NO: 537476 - DNA, 496 bp, Homo sapiens
  misc_feature: HIJSMM301ESP30.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgtctgctcttatgcaggcagtttcgctctcgaagtgttcggcggagggaccgagctgaccgtcctacgtcagcccaac

SEQ ID NO: 537477 - DNA, 490 bp, Homo sapiens; identical to SEQ ID NO: 535936
  misc_feature: HIJSMM301BX6GC.16.68.G02.1.454.light.4.raw

SEQ ID NO: 537478 - DNA, 508 bp, Homo sapiens
  misc_feature: HIJSMM301D0N4R.51.86.H09.1.454.light.4.raw
cgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatcaaacgaactgtggctgcaccatctgtctt

SEQ ID NO: 537479 - DNA, 522 bp, Homo sapiens
  misc_feature: HIJSMM301DEQXQ.16.88.H11.1.454.light.4.raw
tgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcgaaagctgccctgaccctttccgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctccg

SEQ ID NO: 537480 - DNA, 488 bp, Homo sapiens
  misc_feature: HIJSMM301C5W80.52.85.H08.1.454.light.4.raw
cgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattgggggaaatatgcttgctggtatcaacagcggccaggccagtcccctgtactggtcatctatctgaatagtaggcggccctctgggatccctgaccgattctctggctcccactctgggaacacagccactctgaccatcagcgggacccaggctttggatgaggctgactattactgtcaggcgtgggacaccatcactggagtaatattcggcggagggaccagggctgaccgtcctaggtcagcccaaggctgccccctggt

SEQ ID NO: 537481 - DNA, 447 bp, Homo sapiens; identical to SEQ ID NO: 535201
  misc_feature: HIJSMM301A4TNL.18.9.A09.1.454.light.4.raw

SEQ ID NO: 537482 - DNA, 487 bp, Homo sapiens
  misc_feature: HIJSMM301BGV4B.5.40.D07.1.454.light.4.raw
atcagacacgcacgaccggtgctcgatttagtgatagagcgtaacaacaggagggggaggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacaggagttcactctcaccatcagcagcctgcagtctgaagatttgctagtttattactgtcaacagtataatgactggtggacgttcggccaagggaccaaggtggagaccaaacgaactgtggctgcaccat

SEQ ID NO: 537483 - DNA, 505 bp, Homo sapiens
  misc_feature: HIJSMM301B4TJV.19.67.G01.1.454.light.4.raw
tactctcgtgcacgaccggtgctcgatttagagtatacatattgggtttggggagctacaacaggcaggcaggggcgagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaattatttttctatcctccgtgggacgttcggccaagggaccagggtggaaatcagacgaactgtggctgcaccat

SEQ ID NO: 537484 - DNA, 481 bp, Homo sapiens
  misc_feature: HIJSMM301EOXVE.51.51.E07.1.454.light.4.raw
cgatcgtatacacgaccggtgctcgatttagcatactctacaacacacaaaggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagaatcaccttcacttgccgggcgagtcaggacattagcaactatttaaattggtatcagcagaaaccagggaaagcccctaaactcctgatctacgatgcatccaatttggagacaggggtcccatcaaggttcagtggaagtggatctgggacacattttactttcaccatcagcggcctgcagcctgaagattttgcaacatattactgtcaacagtatgaggatctcccactcactttcggcggagggaccaaggtggagatcagacgaactgtggctgca

SEQ ID NO: 537485 - DNA, 511 bp, Homo sapiens
  misc_feature: HIJSMM301BHJKX.43.19.B08.1.454.light.4.raw
tgtgagtagtcacgaccggtgctcgatttagtgagtcagtaaggggctgtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccaccct

SEQ ID NO: 537486 - DNA, 494 bp, Homo sapiens
  misc_feature: HIJSMM301BO2VE.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactattctgtcacacgtgggacatgggcactgcgatcttcggcggagggaccaagctgaccgtcctgggtcagcccaaggctgccccctcggtcactc

SEQ ID NO: 537487 - DNA, 487 bp, Homo sapiens
  misc_feature: HIJSMM301DOLUY.9.59.F04.1.454.light.4.raw
tgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgccccaaccttcggccaggggacacgactggagattaaacgaactgtggctgcaccat

SEQ ID NO: 537488 - DNA, 491 bp, Homo sapiens
  misc_feature: HIJSMM301BFXRR.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagtattccttttactttcggccctgggaccaaagtggatatcaaacgaactgtggctgcaccat

SEQ ID NO: 537489 - DNA, 505 bp, Homo sapiens
  misc_feature: HIJSMM301BHNG8.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttactcaagtagatcaccttcggtccaagggaacacgaacctggaggattaaacgtaaacctgtggcgtgcaccaactctgtctt

SEQ ID NO: 537490 - DNA, 479 bp, Homo sapiens; identical to SEQ ID NO: 535188
  misc_feature: HIJSMM301DRN22.10.74.G08.1.454.light.4.raw

SEQ ID NO: 537491 - DNA, 502 bp, Homo sapiens
  misc_feature: HIJSMM301ERLUR.18.59.F04.1.454.light.4.raw
  modified_base (439)..(439): a, c, t, g, unknown or other
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcacngcactctcaatcgttcgtacgacgtcggaaccgaagtccaccgtcgtagtcacgaccgaacga

SEQ ID NO: 537492 - DNA, 444 bp, Homo sapiens; identical to SEQ ID NO: 535856
  misc_feature: HIJSMM301CQO4L.9.9.A09.1.454.light.4.raw

SEQ ID NO: 537493 - DNA, 487 bp, Homo sapiens; identical to SEQ ID NO: 535508
  misc_feature: HIJSMM301CVFCQ.13.87.H10.1.454.light.4.raw

SEQ ID NO: 537494 - DNA, 464 bp, Homo sapiens; identical to SEQ ID NO: 536640
  misc_feature: HIJSMM301AN616.26.78.H01.1.454.light.4.raw

SEQ ID NO: 537495 - DNA, 487 bp, Homo sapiens
  misc_feature: HIJSMM301AJ0O4.3.55.E11.1.454.light.4.raw
agacgcactccacgaccggtgctcgatttagcactcgcacgttgggtttggggaggaactgctcagttaggacccagacggaaccatggaagccccacgcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaatcaaacgaactgtggctgcaccatctgtt

SEQ ID NO: 537496 - DNA, 491 bp, Homo sapiens
  misc_feature: HIJSMM301A1C2G.51.3.A03.1.454.light.4.raw
cgatcgtatacacgaccggtgctcgatttagagagcgtcacagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgattattattgtcaatcaacagacaccattggtacttatgtcttcggaactgcgaccaaggtcaccgtcctgggtcagcccaaggccaacccactgt

SEQ ID NO: 537497 - DNA, 493 bp, Homo sapiens; identical to SEQ ID NO: 535084
  misc_feature: HIJSMM301A3DJ6.47.64.F09.1.454.light.4.raw

SEQ ID NO: 537498 - DNA, 504 bp, Homo sapiens
  misc_feature: HIJSMM301D2USF.8.71.G05.1.454.light.4.raw
ctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgaagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcgtcaagggaccaaggtggagatcaaacgaactgtggctgcaccatctgtcttcatcttcccgccat

SEQ ID NO: 537499 - DNA, 486 bp, Homo sapiens; identical to SEQ ID NO: 535054
  misc_feature: HIJSMM301DC2JR.47.70.G04.1.454.light.4.raw

SEQ ID NO: 537500 - DNA, 483 bp, Homo sapiens
  misc_feature: HIJSMM301ALWUY.3.46.E02.1.454.light.4.raw
agacgcactccacgaccggtgctcgatttagactcatctacagggaaaggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccaacagaaacctggccaggctcccaggctcctcattcatggtgcatctaacagggccgatggcattccagccaggttcagtggcagtggatatgggacagacttcactctcaccatcagcaatctgcagtctgaagatttgcagtttatttctgtcagcagtttaacacctggcctggaagttttggccaggggaccaagctggagctcaaacgaactgtggctgcaccat

SEQ ID NO: 537501 - DNA, 494 bp, Homo sapiens
  misc_feature: HIJSMM301BAZ2J.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagatttgcagtgtattattgtcagcaatatggtaggtcacctgggacttttggccaggggaccaagctggagatcaaacgaactgtggctgcaccatctgtcttcta

SEQ ID NO: 537502 - DNA, 496 bp, Homo sapiens; identical to SEQ ID NO: 535423
  misc_feature: HIJSMM301CBVXD.3.33.C11.1.454.light.4.raw

SEQ ID NO: 537503 - DNA, 445 bp, Homo sapiens
  misc_feature: HIJSMM301A7K7T.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctcgttcccgccctcctccgtgtctgat

SEQ ID NO: 537504 - DNA, 488 bp, Homo sapiens
  misc_feature: HIJSMM301AUCB1.17.57.F02.1.454.light.4.raw
cgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagcaactttttaaattggtatcagcgggaaccagggaaagcccctaaactcctgatctatactgcatccaatttgcaaagtggggtcccatcaaggttcagtggcagtggatctgggacagatttcactctcaccatcagcagtctgcaacctgaggattttgcaacttactactgtcaacagggttacagtaccccgtacacttttggccaggggaccaagctggagatcaaacgaactgtggctgcaccat

SEQ ID NO: 537505 - DNA, 492 bp, Homo sapiens
  misc_feature: HIJSMM301AXAEC.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccagggaccaagctggagatcaatcgaactgtggc

SEQ ID NO: 537506 - DNA, 507 bp, Homo sapiens
  misc_feature: HIJSMM301CAVVR.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggtcggagggaccgaaggtggaggtcaaacgaactagtggctgcaccatctgtcttcta

SEQ ID NO: 537507 - DNA, 508 bp, Homo sapiens
  misc_feature: HIJSMM301D2SIF.5.86.H09.1.454.light.4.raw
atcagacacgcacgaccggtgctcgatttagtgctatagacttgggtttggggcgtggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactacgtgatttcttgaggtcagtaagcggccctccaggggtcccgtcgatcgcttctctggctccaagtctggcaacacggcctccctgaccgtctctgggctcccagactgaggatgaggctgactattactgcagctcatttgcaggcagccgtatactcttcggcggagggaccaagctgaccgtcctaggtcagcccaaggctgccccctc

SEQ ID NO: 537508 - DNA, 484 bp, Homo sapiens
  misc_feature: HIJSMM301ENQNL.5.40.D07.1.454.light.4.raw
atcagacacgcacgaccggtgctcgatttagtgatagagcgtaacaacagagggggaggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggaccaaggtggagaccaacgaactgtggctgcaccat

SEQ ID NO: 537509 - DNA, 492 bp, Homo sapiens
  misc_feature: HIJSMM301AE2NA.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaactgtgg

SEQ ID NO: 537510 - DNA, 502 bp, Homo sapiens; identical to SEQ ID NO: 537363
  misc_feature: HIJSMM301EMIEB.18.23.C01.1.454.light.4.raw

SEQ ID NO: 537511 - DNA, 511 bp, Homo sapiens
  misc_feature: HIJSMM301C9CPZ.48.41.D08.1.454.light.4.raw
  modified_base (365)..(365): a, c, t, g, unknown or other
agtatacatacacgaccggtgctcgatttagtcacgcgagaaagggaaaggggcgatgagcaaaactagacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagattttcacccctnacccatcaatagcctggaagctgaagatgctgcaacctattactgtcatcagactttttagtttacgtcggaccttcggccaagggacacgactggagattaaacgaactgtggctcgcacccatctgttcttctatctttccccg

SEQ ID NO: 537512 - DNA, 449 bp, Homo sapiens
  misc_feature: HIJSMM301B12SY.47.85.H08.1.454.light.4.raw
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactacataatttattgacgtcaatgttcgcccctccaggggtttcgtcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccgccctcctctacgtgagct

SEQ ID NO: 537513 - DNA, 496 bp, Homo sapiens
  misc_feature: HIJSMM301C65QQ.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaacccactgt

SEQ ID NO: 537514 - DNA, 485 bp, Homo sapiens; identical to SEQ ID NO: 535880
  misc_feature: HIJSMM301DKDJ0.7.75.G09.1.454.light.4.raw

SEQ ID NO: 537515 - DNA, 514 bp, Homo sapiens
  misc_feature: HIJSMM301D33CD.49.17.B06.1.454.light.4.raw
agtcgagagacacgaccggtgctcgatttagtcgatagtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtgtttataactatgtctcctggtaccaacaccacccaggcaaagcccccaaactcatgatttatgatgtcagtgatcggccctcaggggtttcgaatcgcttctctggctccaagtccggcaacacggcctccctgaccatctctggcctcccaggccgaggacgaggctgattattactgcagctcatatacaaccagcaacaattgggtgttcggcggagggaccaaactgaccgtcctaggtcagcccaaggctgccccctcggtcactctgttcccg

SEQ ID NO: 537516 - DNA, 493 bp, Homo sapiens
  misc_feature: HIJSMM301A4K3I.48.27.C05.1.454.light.4.raw
agtatacatacacgaccggtgctcgatttagacgcgatcgaagggtttggggaaccatggaagccccagcgcagcttctcttcctcctgctactctggctcccagaaagcaccggagacattgaactgacgcagtctccaggcaccctgtctttgtctccaggggaaagagccaccctctcctgcagggccggtcggagtctttccagcacctacttagcctggtaccaacaaaaagctggccaggctcccaggctcctcatatatgatgtttctaccagggccactggcattccagacaggttcagtggcagtgggtctgggacagacttcactctcaccatcaacagattggagcctgaagactctgcagtctatttctgtcagcaatatcgcagttcagtctcgtacacttttggccaggggaccacgctggagatcaaacgaactgtggctgcaccatctgtcttcatcttcccgccatctgatatgta

SEQ ID NO: 537517 - DNA, 464 bp, Homo sapiens
  misc_feature: HIJSMM301DDSYB.14.57.F02.1.454.light.4.raw
cgtctagtaccacgaccggtgctcgatttagctcgatatagttgggtttgggggaggaactgctcagttaggacccagagggaacaatggaagccccagctcagcttctcttcctcctgctactctggctcccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaaggtggagttcaaacgaactgtggctgcaccatctgtcttcatcttcccgccatctgagtactagacg

SEQ ID NO: 537518 - DNA, 503 bp, Homo sapiens
  misc_feature: HIJSMM301BKTYO.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattgagatcaaacgaactgtggctgcaccatctgtcttcatcttcccgcc

SEQ ID NO: 537519 - DNA, 494 bp, Homo sapiens; identical to SEQ ID NO: 534992
  misc_feature: HIJSMM301BHKVM.9.1.A01.1.454.light.4.raw

SEQ ID NO: 537520 - DNA, 478 bp, Homo sapiens
  misc_feature: HIJSMM301DCOAK.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgcagtttattactgtcagcagtatactaactggcctctgacgttcggccaagggaccagggtgaaatcaaacgaactgtggctgcaccat

SEQ ID NO: 537521 - DNA, 485 bp, Homo sapiens
  misc_feature: HIJSMM301BQYD8.5.42.D09.1.454.light.4.raw
atcagacacgcacgaccggtgctcgatttagacacatacgcagggaaagggggagtcagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagagttcactctcacaatcagcagcctgcagcctgatgatcttggaacttattactgccaacaatataatagttattggacgttcggccaggggacgaaggtcgaaatagagacgaactgtggctgcaccatctgt

SEQ ID NO: 537522 - DNA, 500 bp, Homo sapiens; identical to SEQ ID NO: 536183
  misc_feature: HIJSMM301B1GS2.10.17.B06.1.454.light.4.raw

SEQ ID NO: 537523 - DNA, 497 bp, Homo sapiens; identical to SEQ ID NO: 535664
  misc_feature: HIJSMM301C9WTL.22.14.B03.1.454.light.4.raw

SEQ ID NO: 537524 - DNA, 495 bp, Homo sapiens; identical to SEQ ID NO: 535596
  misc_feature: HIJSMM301BFXQB.10.79.H02.1.454.light.4.raw

SEQ ID NO: 537525 - DNA, 494 bp, Homo sapiens; identical to SEQ ID NO: 534992
  misc_feature: HIJSMM301AWTU2.9.1.A01.1.454.light.4.raw

SEQ ID NO: 537526 - DNA, 508 bp, Homo sapiens; identical to SEQ ID NO: 536388
  misc_feature: HIJSMM301CK90Z.11.57.F02.1.454.light.4.raw

SEQ ID NO: 537527 - DNA, 488 bp, Homo sapiens
  misc_feature: HIJSMM301EGB9A.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatct

SEQ ID NO: 537528 - DNA, 490 bp, Homo sapiens
  misc_feature: HIJSMM301DDDH1.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggaacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 537529 - DNA, 495 bp, Homo sapiens; identical to SEQ ID NO: 536055
  misc_feature: HIJSMM301ASD99.47.38.D05.1.454.light.4.raw

SEQ ID NO: 537530 - DNA, 481 bp, Homo sapiens
  misc_feature: HIJSMM301DKPVE.19.71.G05.1.454.light.4.raw
  modified_base (476)..(476): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttatcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgcaggacaagtaggatatcanacgaa

SEQ ID NO: 537531 - DNA, 512 bp, Homo sapiens
  misc_feature: HIJSMM301EZVIF.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctacttacgtcggacgggacgaacgaggacgagtactacgacgaacgtacgtggtcgtcgtcgaccaactactcgttcgttcctta

SEQ ID NO: 537532 - DNA, 491 bp, Homo sapiens
  misc_feature: HIJSMM301BITLB.48.9.A09.1.454.light.4.raw
agtatacatacacgaccggtgctcgatttagcgagacgcgcagggggagtcagacccagtcaggacacagcatggacatgagggtccccgctcagctcctggggctcctgctgctctggctcccaggtgccaaatgcggacagtccaaggatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaagggaccagggtggaaatcaaacgaaacctagtggctgcaccatctgtctt

SEQ ID NO: 537533 - DNA, 500 bp, Homo sapiens
  misc_feature: HIJSMM301DJ1YJ.49.37.D04.1.454.light.4.raw
agtcgagagacacgaccggtgctcgatttagtagcatactgttgggtttggggactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgtttttcggcggagggaccaggctgaccgtcctgggtcagcccaaggctgccccctcggtcactctgttcccgcctcctctct

SEQ ID NO: 537534 - DNA, 495 bp, Homo sapiens; identical to SEQ ID NO: 535143
  misc_feature: HIJSMM301CES3I.51.29.C07.1.454.light.4.raw

SEQ ID NO: 537535 - DNA, 419 bp, Homo sapiens
  misc_feature: HIJSMM301DHICY.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccaccctcctccatactcgta

SEQ ID NO: 537536 - DNA, 487 bp, Homo sapiens
  misc_feature: HIJSMM301AIFDY.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttgggggtttattactgcatgcaagttctacaaacttcctacacttttggccaggggccaagctggagatcaaacgaa

SEQ ID NO: 537537 - DNA, 497 bp, Homo sapiens
  misc_feature: HIJSMM301AJORH.43.78.H01.1.454.light.4.raw
tgtgagtagtcacgaccggtgctcgatttagtgtgagtagtttgggtttggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttggggtttattactgcatgcaaggtacacactggcccgtcaccttcggccaagggacacgactggagattaaacgaactgtggctgca

SEQ ID NO: 537538 - DNA, 496 bp, Homo sapiens
  misc_feature: HIJSMM301CCI4W.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgctctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaac

SEQ ID NO: 537539 - DNA, 494 bp, Homo sapiens
  misc_feature: HIJSMM301DFTDB.2.49.E05.1.454.light.4.raw
acgctcgacacacgaccggtgctcgatttagagcgactagcaacacacaaaggggggagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctaccaagtctggcacctcagcctccctggccatcagtgggctccggtccgaggatgaggctgattattactgtgttggatgggacagcagcctgagtgcttatgtcttcggaactgggaccacggtcaccgtcct

SEQ ID NO: 537540 - DNA, 444 bp, Homo sapiens; identical to SEQ ID NO: 535192
  misc_feature: HIJSMM301D8FW8.5.9.A09.1.454.light.4.raw

SEQ ID NO: 537541 - DNA, 495 bp, Homo sapiens; identical to SEQ ID NO: 535007
  misc_feature: HIJSMM301BPA9T.22.5.A05.1.454.light.4.raw

SEQ ID NO: 537542 - DNA, 507 bp, Homo sapiens
  misc_feature: HIJSMM301CM37C.41.33.C11.1.454.light.4.raw
tctatactatcacgaccggtgctcgatttagagtgagctcgttgggtttggggctgggcctcaggaagcagcatcggaggtgcctcagccatggcgtggatccctctcttcctcggcgtccttgcttcctgcacagtttccgtggcctcctcggaattgactcaggcaccctcagtgtccgtgtctccaggacagacagccagaatcacctgctctggagacacgttgggggagacatttgcttcctggtatcaacagaggccaggccagtcccctatcctggtcatctttcaggatgacaaacggccctctggcatccctgaacgcttctctggttccaggtcaggaaacagagccactctaaccatcaccgagacccaggctgtcgatgaggctgactattactgtcaggcctgggacagaaacactggcatattcggcggagggaccaagctgaccgtcctacgtcagcccaaggctgccccctcggtcactctgttcctcccg

SEQ ID NO: 537543 - DNA, 479 bp, Homo sapiens; identical to SEQ ID NO: 535118
  misc_feature: HIJSMM301AS8ZY.13.59.F04.1.454.light.4.raw

SEQ ID NO: 537544 - DNA, 488 bp, Homo sapiens
  misc_feature: HIJSMM301CMDTD.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccactttggccaagggaccaagctggagatcaaacgaactgtggctgcacca

SEQ ID NO: 537545 - DNA, 501 bp, Homo sapiens
  misc_feature: HIJSMM301BTGBV.49.69.G03.1.454.light.4.raw
agtcgagagacacgaccggtgctcgatttagtcgctgcgtaaaggagaaagggggaggaactgctcagttaggacccagagggaaccatggaagccccagctcagcttctcttcctcctgcttctctggctcccagatattaccggagaaattgtgttgacgcagtctccagccaccctgtctttgtctccaggggaaagagccaccctctcctgcagggccagtcagagtgttaacatctacttagtctggtaccaacagaaagctggccacgctcccaggctcctcatctatgatacatccaccagggcccctggcatcccagccaggttcagtggcagtgggtctgggacagacttcactctcaccatcagcagcttagagcctgaagattttgcagtttattactgtcagcagcgtatcaccgggatcaccttcggccaagggacccgactggagattaagcgaactgtggctgcaccatctgtcttcatcttcccg

SEQ ID NO: 537546 - DNA, 418 bp, Homo sapiens
  misc_feature: HIJSMM301CSARA.19.86.H09.1.454.light.4.raw
tactctcgtgcacgaccggtgctcgatttagtgctatagacttgggtttgggggccgttcctgggactttctgataccacatcacaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccacgagagta

SEQ ID NO: 537547 - DNA, 494 bp, Homo sapiens; identical to SEQ ID NO: 535276
  misc_feature: HIJSMM301BOOH2.16.6.A06.1.454.light.4.raw

SEQ ID NO: 537548 - DNA, 485 bp, Homo sapiens
  misc_feature: HIJSMM301CUNNV.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatggggatagtagcctgagtagtgtggttttcggcggagggaccaaactgaccgtcctaggtcagcccaaggctgcccctcggtcactctgttcccgccctcctctacgtgagct

SEQ ID NO: 537549 - DNA, 484 bp, Homo sapiens; identical to SEQ ID NO: 536162
  misc_feature: HIJSMM301DNNBI.13.59.F04.1.454.light.4.raw

SEQ ID NO: 537550 - DNA, 494 bp, Homo sapiens; identical to SEQ ID NO: 535276
  misc_feature: HIJSMM301A741L.16.6.A06.1.454.light.4.raw

SEQ ID NO: 537551 - DNA, 486 bp, Homo sapiens
  misc_feature: HIJSMM301CRT53.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccagggacgacgactgagataaacgtaaactgtggctgcaccatctgtt

SEQ ID NO: 537552 - DNA, 481 bp, Homo sapiens; identical to SEQ ID NO: 535993
  misc_feature: HIJSMM301BQPGA.21.25.C03.1.454.light.4.raw

SEQ ID NO: 537553 - DNA, 517 bp, Homo sapiens
  misc_feature: HIJSMM301A4YQS.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccacggaccgaacggtaggaagtacgaaacgaactacgtggcgtgcgaccactctgtcttctatcttcccgtcccact

SEQ ID NO: 537554 - DNA, 447 bp, Homo sapiens
  misc_feature: HIJSMM301DIDYM.47.85.H08.1.454.light.4.raw
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctccaggggtttcgtcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccaccctcctctacgtgagct

SEQ ID NO: 537555 - DNA, 476 bp, Homo sapiens
  misc_feature: HIJSMM301BYV0E.26.72.G06.1.454.light.4.raw
agactatactcacgaccggtgctcgatttagctacgactgcaagggaaagggtgagatccctcactgtggctcactttcagcggagggaccacgatggagatcacacgtaagtgcactttcctaatgctttttcttataaggttttaagtttggagcgtttttgtgtttgagatgttagctcaggtcaattccaaagagtaccagattcttcaaaagtcagatgagtaagggatagaaattagttcaccttaaggaacagccaagcgctagccagttaagtgaggcatctcaattgcaaggttttctctgcatcggtcaggttagtgatattaacagcgaaaagagtatttttgttaaggggaaagtaatgaagttaacactgtggatcaccttcggccaagggacacgactggagattaaacgaactgtggctgcaccatctgtcttcatcttcccgccatctgaagtatagtct

SEQ ID NO: 537556 - DNA, 502 bp, Homo sapiens
  misc_feature: HIJSMM301AGIRJ.52.34.D01.1.454.light.4.raw
cgcagtacgacacgaccggtgctcgatttagatcgtctgtgttgggtttgggggaggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcttccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcta

SEQ ID NO: 537557 - DNA, 490 bp, Homo sapiens
  misc_feature: HIJSMM301CH3MU.16.68.G02.1.454.light.4.raw
  modified_base (466)..(466): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaagaacngtggctgcaccatctgtcttcatt

SEQ ID NO: 537558 - DNA, 479 bp, Homo sapiens
  misc_feature: HIJSMM301AV883.47.48.E04.1.454.light.4.raw
agctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggacttgtccaggacgaagtaggaagtacaacaactagtggcgtgcacca

SEQ ID NO: 537559 - DNA, 494 bp, Homo sapiens; identical to SEQ ID NO: 534992
  misc_feature: HIJSMM301D2B7X.9.1.A01.1.454.light.4.raw

SEQ ID NO: 537560 - DNA, 503 bp, Homo sapiens; identical to SEQ ID NO: 536834
  misc_feature: HIJSMM301C5M8Z.2.35.D02.1.454.light.4.raw

SEQ ID NO: 537561 - DNA, 449 bp, Homo sapiens
  misc_feature: HIJSMM301DAQ47.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggcccaacccctctgtcactctcgttcccgccctcctccatactcgta

SEQ ID NO: 537562 - DNA, 488 bp, Homo sapiens
  misc_feature: HIJSMM301C2Z8A.48.53.E09.1.454.light.4.raw
agtatacatacacgaccggtgctcgatttagagagagtgtgttgggtttggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccgaaggtggagatcaaacgaactgtggctgca

SEQ ID NO: 537563 - DNA, 481 bp, Homo sapiens; identical to SEQ ID NO: 535061
  misc_feature: HIJSMM301ANAXN.16.81.H04.1.454.light.4.raw

SEQ ID NO: 537564 - DNA, 512 bp, Homo sapiens
  misc_feature: HIJSMM301DCVJK.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccacctcct

SEQ ID NO: 537565 - DNA, 507 bp, Homo sapiens
  misc_feature: HIJSMM301DQGVM.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctctaccttcgtcggagggaccgaacggacggacggatacacgaacgaacgtacgtggcgtcgcaccaactctgtcttcctta

SEQ ID NO: 537566 - DNA, 453 bp, Homo sapiens
  misc_feature: HIJSMM301A4AHM.19.86.H09.1.454.light.4.raw
tactctcgtgcacgaccggtgctcgatttagtgctatagacttgggtttgggggtcgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctccggtcactctgttcccaccctcctccacgagagt

SEQ ID NO: 537567 - DNA, 491 bp, Homo sapiens
  misc_feature: HIJSMM301EMEV6.48.38.D05.1.454.light.4.raw
agtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgcccccc

SEQ ID NO: 537568 - DNA, 361 bp, Homo sapiens
  misc_feature: HIJSMM301EX8FE.3.57.F02.1.454.light.4.raw
agacgcactccacgaccggtgctcgatttagctcgatatagttgggtttgggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggtcttcggcggcgggaccaagctgaccgtcctatgtcaacccaaggccaaccccactgtcactctgttcccaccctcctcgagtgcgtct

SEQ ID NO: 537569 - DNA, 494 bp, Homo sapiens; identical to SEQ ID NO: 534994
  misc_feature: HIJSMM301DTN88.27.78.H01.1.454.light.4.raw

SEQ ID NO: 537570 - DNA, 475 bp, Homo sapiens
  misc_feature: HIJSMM301BNUND.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaagggacacgactggagattaaacgaactgtggctgcacc

SEQ ID NO: 537571 - DNA, 479 bp, Homo sapiens
  misc_feature: HIJSMM301AWC4F.48.53.E09.1.454.light.4.raw
agtatacatacacgaccggtgctcgatttagagagagtgtgttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaac

SEQ ID NO: 537572 - DNA, 498 bp, Homo sapiens
  misc_feature: HIJSMM301CNW52.52.37.D04.1.454.light.4.raw
cgcagtacgacacgaccggtgctcgatttagtagcatactgttgggtttggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcat

SEQ ID NO: 537573 - DNA, 487 bp, Homo sapiens
  misc_feature: HIJSMM301BC1A3.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaacccca

SEQ ID NO: 537574 - DNA, 444 bp, Homo sapiens; identical to SEQ ID NO: 535594
  misc_feature: HIJSMM301DGO8O.9.9.A09.1.454.light.4.raw

SEQ ID NO: 537575 - DNA, 493 bp, Homo sapiens
  misc_feature: HIJSMM301AI1ZC.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgcaacagtataagagttattcaactttcggtccctcgggaccgaactagtggagtatctaaacgaaacctagtggcgtgcaccatactgtt

SEQ ID NO: 537576 - DNA, 513 bp, Homo sapiens; identical to SEQ ID NO: 535244
  misc_feature: HIJSMM301BT27O.17.33.C11.1.454.light.4.raw

SEQ ID NO: 537577 - DNA, 494 bp, Homo sapiens; identical to SEQ ID NO: 534992
  misc_feature: HIJSMM301BKN4Y.9.1.A01.1.454.light.4.raw

SEQ ID NO: 537578 - DNA, 414 bp, Homo sapiens
  misc_feature: HIJSMM301CYR1X.16.46.E02.1.454.light.4.raw
tgtactactccacgaccggtgctcgatttagactcatctacagggaaaggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcactctgttcccaccctcctcgagtagtaca

SEQ ID NO: 537579 - DNA, 448 bp, Homo sapiens; identical to SEQ ID NO: 534998
  misc_feature: HIJSMM301CBZ73.18.9.A09.1.454.light.4.raw

SEQ ID NO: 537580 - DNA, 486 bp, Homo sapiens; identical to SEQ ID NO: 535043
  misc_feature: HIJSMM301AF60L.46.35.D02.1.454.light.4.raw

SEQ ID NO: 537581 - DNA, 492 bp, Homo sapiens; identical to SEQ ID NO: 535126
  misc_feature: HIJSMM301BUIT9.18.11.A11.1.454.light.4.raw

SEQ ID NO: 537582 - DNA, 492 bp, Homo sapiens
  misc_feature: HIJSMM301ECO7P.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttctccatgcaaggtacacactggccttttggccaggggaccaacctggagatcaaatgaactgtggctgcaccatctgtctt

SEQ ID NO: 537583 - DNA, 486 bp, Homo sapiens
  misc_feature: HIJSMM301A0ECM.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatctgt

SEQ ID NO: 537584 - DNA, 522 bp, Homo sapiens
  misc_feature: HIJSMM301CISH4.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctcccttgggggcgaaagctgccctgacactgtctggtgtgcagcctgaggacgaggctgactattactgcctactctactttgtggtgctgtgctattcggcggagggaccgaacgactgaccgtccttaagttcagcccaacggcgtcgccccctccggtccactctgttcccgt

SEQ ID NO: 537585 - DNA, 485 bp, Homo sapiens; identical to SEQ ID NO: 535501
  misc_feature: HIJSMM301EFQ9I.3.10.A10.1.454.light.4.raw

SEQ ID NO: 537586 - DNA, 489 bp, Homo sapiens; identical to SEQ ID NO: 535386
  misc_feature: HIJSMM301B1SF3.12.51.E07.1.454.light.4.raw

SEQ ID NO: 537587 - DNA, 484 bp, Homo sapiens; identical to SEQ ID NO: 535400
  misc_feature: HIJSMM301ENPIG.46.26.C04.1.454.light.4.raw

SEQ ID NO: 537588 - DNA, 494 bp, Homo sapiens; identical to SEQ ID NO: 534994
  misc_feature: HIJSMM301CMO9D.27.78.H01.1.454.light.4.raw

SEQ ID NO: 537589 - DNA, 504 bp, Homo sapiens
  misc_feature: HIJSMM301A4PI1.8.33.C11.1.454.light.4.raw
ctcgcgtgtccacgaccggtgctcgatttagagtgagctcgttgggtttgggggaactgctcagttaggacccagagggaaccatggaagccccagctcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgccat

SEQ ID NO: 537590 - DNA, 468 bp, Homo sapiens
  misc_feature: HIJSMM301ASHM8.14.55.E11.1.454.light.4.raw
  modified_base (424)..(424): a, c, t, g, unknown or other
  modified_base (457)..(457): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagatttgcaacttactactgtcaacagagttacagtacccccncctctacgttcggacggacggacgaggcgaganacagacacgtg

SEQ ID NO: 537591 - DNA, 502 bp, Homo sapiens
  misc_feature: HIJSMM301CL0S9.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcggtggttcggcgggggaccgaagctgaccgtcctaggtcagcccaaggctgccccctcggtcactctgttccccg

SEQ ID NO: 537592 - DNA, 488 bp, Homo sapiens
  misc_feature: HIJSMM301CWOKK.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggcccaggggaccaagctggagatcaggcgaacg

SEQ ID NO: 537593 - DNA, 367 bp, Homo sapiens
  misc_feature: HIJSMM301DVNJU.41.34.D01.1.454.light.4.raw
tctatactatcacgaccggtgctcgatttagatcgtctgtgttgggtttgggggagtcagacccagtcaggacacagcatggacatgagggtccccgctcagctcccggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacga

SEQ ID NO: 537594 - DNA, 491 bp, Homo sapiens
  misc_feature: HIJSMM301EC99N.4.24.C02.1.454.light.4.raw
agcactgtagcacgaccggtgctcgatttagtacagatcgttagggaaagggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataacagttattggacgttcggccaagggaccaaggtggaaatcagacgaactgtggctgcaccatctgtcttcta

SEQ ID NO: 537595 - DNA, 507 bp, Homo sapiens
  misc_feature: HIJSMM301EA7I6.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccaaggtggaaagtacaaacgaactagtggctgcaccatctgtcttctatcttccccg

SEQ ID NO: 537596 - DNA, 447 bp, Homo sapiens; identical to SEQ ID NO: 535201
  misc_feature: HIJSMM301D80WC.18.9.A09.1.454.light.4.raw

SEQ ID NO: 537597 - DNA, 494 bp, Homo sapiens; identical to SEQ ID NO: 536444
  misc_feature: HIJSMM301A9FUE.26.72.G06.1.454.light.4.raw

SEQ ID NO: 537598 - DNA, 449 bp, Homo sapiens
  misc_feature: HIJSMM301DQLPP.18.9.A09.1.454.light.4.raw
tacgagtatgcacgaccggtgctcgatttagcgagacgcgcgagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcacgcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 537599 - DNA, 449 bp, Homo sapiens
  misc_feature: HIJSMM301BI02M.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccactactcgta

SEQ ID NO: 537600 - DNA, 504 bp, Homo sapiens; identical to SEQ ID NO: 535561
  misc_feature: HIJSMM301BP5F4.4.57.F02.1.454.light.4.raw

SEQ ID NO: 537601 - DNA, 494 bp, Homo sapiens; identical to SEQ ID NO: 534992
  misc_feature: HIJSMM301EEO25.9.1.A01.1.454.light.4.raw

SEQ ID NO: 537602 - DNA, 444 bp, Homo sapiens; identical to SEQ ID NO: 535192
  misc_feature: HIJSMM301CSNEY.5.9.A09.1.454.light.4.raw

SEQ ID NO: 537603 - DNA, 498 bp, Homo sapiens
  misc_feature: HIJSMM301D2L6O.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgtttcggcggagggaccaaggtggagatcaaacgaactgtggctgcaccatctgtcttcatcttcccgccatctgac

SEQ ID NO: 537604 - DNA, 464 bp, Homo sapiens; identical to SEQ ID NO: 536640
  misc_feature: HIJSMM301EP84G.26.78.H01.1.454.light.4.raw

SEQ ID NO: 537605 - DNA, 483 bp, Homo sapiens
  misc_feature: HIJSMM301B4R55.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagaatgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaa

SEQ ID NO: 537606 - DNA, 482 bp, Homo sapiens
  misc_feature: HIJSMM301DVDZC.14.55.E11.1.454.light.4.raw
  modified_base (458)..(458): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcgtcggaggacgaagacggagatcanacgaactgtggctgcaccatctgt

SEQ ID NO: 537607 - DNA, 494 bp, Homo sapiens
  misc_feature: HIJSMM301D4O1N.52.10.A10.1.454.light.4.raw
cgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaaacctgcccaggctcccaggctcctcatctatgatgcatccaatcgggccactggcatcccagccaggttcagtggcagtgggtctgggacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgccat

SEQ ID NO: 537608 - DNA, 483 bp, Homo sapiens
  misc_feature: HIJSMM301AU7FX.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaacgaactgtggctgcaccat

SEQ ID NO: 537609 - DNA, 448 bp, Homo sapiens; identical to SEQ ID NO: 534998
  misc_feature: HIJSMM301DMV11.18.9.A09.1.454.light.4.raw

SEQ ID NO: 537610 - DNA, 483 bp, Homo sapiens
  misc_feature: HIJSMM301DG84O.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgcttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagcccaaggctgcccccc

SEQ ID NO: 537611 - DNA, 472 bp, Homo sapiens; identical to SEQ ID NO: 535898
  misc_feature: HIJSMM301AHP23.15.8.A08.1.454.light.4.raw

SEQ ID NO: 537612 - DNA, 494 bp, Homo sapiens; identical to SEQ ID NO: 534992
  misc_feature: HIJSMM301BHJ6C.9.1.A01.1.454.light.4.raw

SEQ ID NO: 537613 - DNA, 501 bp, Homo sapiens; identical to SEQ ID NO: 535746
  misc_feature: HIJSMM301BHA6O.18.11.A11.1.454.light.4.raw

SEQ ID NO: 537614 - DNA, 447 bp, Homo sapiens; identical to SEQ ID NO: 535201
  misc_feature: HIJSMM301BSACP.18.9.A09.1.454.light.4.raw

SEQ ID NO: 537615 - DNA, 479 bp, Homo sapiens
  misc_feature: HIJSMM301CNGVQ.21.25.C03.1.454.light.4.raw
tcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcggacc

SEQ ID NO: 537616 - DNA, 485 bp, Homo sapiens; identical to SEQ ID NO: 535688
  misc_feature: HIJSMM301DYW20.19.5.A05.1.454.light.4.raw

SEQ ID NO: 537617 - DNA, 486 bp, Homo sapiens
  misc_feature: HIJSMM301BC3RM.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaaacgaa

SEQ ID NO: 537618 - DNA, 474 bp, Homo sapiens
  misc_feature: HIJSMM301CPJYQ.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggaggaccgaaggtggagatcaaagaactgtgg

SEQ ID NO: 537619 - DNA, 487 bp, Homo sapiens
  misc_feature: HIJSMM301AG75C.52.23.C01.1.454.light.4.raw
cgcagtacgacacgaccggtgctcgatttagtacacgtgattagggattggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggcggagggaccgaaggtggagatcagacgaactgtggctgcaccatctgtctt

SEQ ID NO: 537620 - DNA, 440 bp, Homo sapiens
  misc_feature: HIJSMM301BCZ7I.41.9.A09.1.454.light.4.raw
tctatactatcacgaccggtgctcgatttagcgagacgcgcagggtcctaggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccgccctcctatagtataga

SEQ ID NO: 537621 - DNA, 478 bp, Homo sapiens; identical to SEQ ID NO: 535129
  misc_feature: HIJSMM301BBEC1.11.11.A11.1.454.light.4.raw

SEQ ID NO: 537622 - DNA, 494 bp, Homo sapiens
  misc_feature: HIJSMM301BPOLK.3.14.B03.1.454.light.4.raw
agacgcactccacgaccggtgctcgatttagtgtgagtagttccgcgggcacgaccggtgctcgatttagtgtgagtagtttgggtttggggaggaactgctcagttaggacccagagggaaccatggaagccccagcccagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagatttcgcagtttattactgtcagcagcgtagcaactggctgatcaccttcggcccaagggacacga

SEQ ID NO: 537623 - DNA, 492 bp, Homo sapiens; identical to SEQ ID NO: 536010
  misc_feature: HIJSMM301APCMO.10.20.B09.1.454.light.4.raw

SEQ ID NO: 537624 - DNA, 486 bp, Homo sapiens; identical to SEQ ID NO: 535458
  misc_feature: HIJSMM301BLOJ4.7.75.G09.1.454.light.4.raw

SEQ ID NO: 537625 - DNA, 504 bp, Homo sapiens
  misc_feature: HIJSMM301AGBXJ.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataataccatttaatttacggtcggagggaccgaacggtaggaggatcaaacgaaactacgtggcgtgcaccactactgtcttcatcttcccgtcc

SEQ ID NO: 537626 - DNA, 498 bp, Homo sapiens
  misc_feature: HIJSMM301AGDMJ.52.35.D02.1.454.light.4.raw
cgcagtacgacacgaccggtgctcgatttagcacacgatagttgggtttggggggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttcccg

SEQ ID NO: 537627 - DNA, 492 bp, Homo sapiens
  misc_feature: HIJSMM301BRIWA.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggaggatcaaacgaactgtggctgcaccatct

SEQ ID NO: 537628 - DNA, 440 bp, Homo sapiens
  misc_feature: HIJSMM301BJUNA.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgcccctcggtcactctgttcccaccctcctcatagtataga

SEQ ID NO: 537629 - DNA, 484 bp, Homo sapiens; identical to SEQ ID NO: 535441
  misc_feature: HIJSMM301ALW7M.26.60.F05.1.454.light.4.raw

SEQ ID NO: 537630 - DNA, 486 bp, Homo sapiens; identical to SEQ ID NO: 535043
  misc_feature: HIJSMM301EVJME.46.35.D02.1.454.light.4.raw

SEQ ID NO: 537631 - DNA, 494 bp, Homo sapiens; identical to SEQ ID NO: 535276
  misc_feature: HIJSMM301ELQ6E.16.6.A06.1.454.light.4.raw

SEQ ID NO: 537632 - DNA, 496 bp, Homo sapiens; identical to SEQ ID NO: 536229
  misc_feature: HIJSMM301ANCB7.16.78.H01.1.454.light.4.raw

SEQ ID NO: 537633 - DNA, 479 bp, Homo sapiens
  misc_feature: HIJSMM301EIY4G.40.8.A08.1.454.light.4.raw
tctagcgactcacgaccggtgctcgatttagcatactctacagggggagctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagactgttttatacagctccaacaatgagaactacgttgcttggtaccagcagaaaccaggacagcctcctaagttgctcatttactgggcatctacccgggcatccggggtccctgaccgattcagtggcagcgggtctgggacagatttcactctcaccatcaacaacctgcaggctgaagatgtggcagtttattactgtcaacaatattatactactccgctcactttcggcggtaggcaccacggtggagatcagcgaa

SEQ ID NO: 537634 - DNA, 494 bp, Homo sapiens; identical to SEQ ID NO: 535828
  misc_feature: HIJSMM301BYDQM.3.36.D03.1.454.light.4.raw

SEQ ID NO: 537635 - DNA, 496 bp, Homo sapiens
  misc_feature: HIJSMM301BF9SM.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaaggctgaccgtcctaggtcagcccaaggctgccccctcggtcactctgttcccacctcct

SEQ ID NO: 537636 - DNA, 489 bp, Homo sapiens
  misc_feature: HIJSMM301BMP1N.19.15.B04.1.454.light.4.raw
tactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccatcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaagggaccaaggtagaaatgaaacgaactgtggctgcaccat

SEQ ID NO: 537637 - DNA, 444 bp, Homo sapiens
  misc_feature: HIJSMM301CF7KT.8.11.A11.1.454.light.4.raw
ctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaggaaaagcccccggactcctcatttttgttaacaacgatcgcccctcaggggtccctgaccgcttctctggctccaggtctggcgcctctgcctccctggccatcgctgggctccaccttgacgatgagggtttttattactgccagtcgtacgacgacagtctgactgccccggtgttcggcggcgggaccaaggtgaccgtcctgagtcagcccaaggctgcccccacggtcactctgttcccgccctcctcgacacgcgag

SEQ ID NO: 537638 - DNA, 496 bp, Homo sapiens
  misc_feature: HIJSMM301B9FML.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttttactgtcagcagtatagtaactggcctccgtactacttttggccaggggaccaagctagaaatcaaacgaactgtggctgcaccatctgtcttcta

SEQ ID NO: 537639 - DNA, 496 bp, Homo sapiens
  misc_feature: HIJSMM301C686S.10.37.D04.1.454.light.4.raw
catagtagtgcacgaccggtgctcgatttagtagcatactgttgggtttgggggctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctccgtggacttcggccaagggaccaaggtggacctcaaacgaactgtggctgcaccat

SEQ ID NO: 537640 - DNA, 488 bp, Homo sapiens; identical to SEQ ID NO: 535990
  misc_feature: HIJSMM301BFF00.11.28.C06.1.454.light.4.raw

SEQ ID NO: 537641 - DNA, 444 bp, Homo sapiens
  misc_feature: HIJSMM301CYXU9.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagttccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccgccctcctccgtgtctgat

SEQ ID NO: 537642 - DNA, 501 bp, Homo sapiens; identical to SEQ ID NO: 535509
  misc_feature: HIJSMM301BVS7B.15.56.F01.1.454.light.4.raw

SEQ ID NO: 537643 - DNA, 481 bp, Homo sapiens
  misc_feature: HIJSMM301DIUF9.53.71.G05.1.454.light.4.raw
cgcgtatacacacgaccggtgctcgatttagtgtcgtcgcaagagagaggggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcggcggagggaccaagctgaccgtcctaggtcagcccaaggctgccccctcggtcactctgttcccaccctcctctcgtactgcg

SEQ ID NO: 537644 - DNA, 482 bp, Homo sapiens; identical to SEQ ID NO: 535352
  misc_feature: HIJSMM301CUUSQ.16.81.H04.1.454.light.4.raw

SEQ ID NO: 537645 - DNA, 492 bp, Homo sapiens
  misc_feature: HIJSMM301CKLT1.41.72.G06.1.454.light.4.raw
tctatactatcacgaccggtgctcgatttagctacgactgcaagggaaaggggctccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcatgggacagcagcctcacaaattggatgttcggcggagggaccaagctgaccgtcctaggtcagccccg

SEQ ID NO: 537646 - DNA, 485 bp, Homo sapiens; identical to SEQ ID NO: 535880
  misc_feature: HIJSMM301C4AF8.7.75.G09.1.454.light.4.raw

SEQ ID NO: 537647 - DNA, 475 bp, Homo sapiens
  misc_feature: HIJSMM301B1DMP.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgtatttgctcctccgagtgcctacgttttgggcggggggaccaaggtggacatcaaacgaa

SEQ ID NO: 537648 - DNA, 489 bp, Homo sapiens
  misc_feature: HIJSMM301E144K.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaaggaccgaaagtaggacatcaagcgaactgtggctgcaccatct

SEQ ID NO: 537649 - DNA, 447 bp, Homo sapiens
  misc_feature: HIJSMM301EGDRH.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctccccatactcgta

SEQ ID NO: 537650 - DNA, 480 bp, Homo sapiens
  misc_feature: HIJSMM301AN8MO.43.63.F08.1.454.light.4.raw
tgtgagtagtcacgaccggtgctcgatttagcgatcgtataagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcgtacgttcggccaagggaccaaggtggaaatcaaacgaactgtggctgcacca

SEQ ID NO: 537651 - DNA, 498 bp, Homo sapiens; identical to SEQ ID NO: 537020
  misc_feature: HIJSMM301C82Y0.26.26.C04.1.454.light.4.raw

SEQ ID NO: 537652 - DNA, 495 bp, Homo sapiens; identical to SEQ ID NO: 535821
  misc_feature: HIJSMM301BYMO2.3.31.C09.1.454.light.4.raw

SEQ ID NO: 537653 - DNA, 488 bp, Homo sapiens
  misc_feature: HIJSMM301BYIU5.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaacgtcaaacgaa

SEQ ID NO: 537654 - DNA, 444 bp, Homo sapiens; identical to SEQ ID NO: 534993
  misc_feature: HIJSMM301CF556.5.9.A09.1.454.light.4.raw

SEQ ID NO: 537655 - DNA, 491 bp, Homo sapiens
  misc_feature: HIJSMM301DPWNQ.14.53.E09.1.454.light.4.raw
cgtctagtaccacgaccggtgctcgatttagagagagtgtgttgggtttggggggtccgaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgcccctcggt

SEQ ID NO: 537656 - DNA, 501 bp, Homo sapiens
  misc_feature: HIJSMM301CKKM4.15.1.A01.1.454.light.4.raw
tctacgtagccacgaccggtgctcgatttagacgtctcatcagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactc

SEQ ID NO: 537657 - DNA, 488 bp, Homo sapiens; identical to SEQ ID NO: 536554
  misc_feature: HIJSMM301B2BXB.26.37.D04.1.454.light.4.raw

SEQ ID NO: 537658 - DNA, 490 bp, Homo sapiens
  misc_feature: HIJSMM301DM0UB.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggtcggagggaccaaggcggagatcagacgaactgtggctgcaccatctgtcttcta

SEQ ID NO: 537659 - DNA, 504 bp, Homo sapiens
  misc_feature: HIJSMM301C923F.13.55.E11.1.454.light.4.raw
tcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaagacctacttgaattggtttcagcagaggccaggccagtctccaaggcgcctaatttataatgtttttacccgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtt

SEQ ID NO: 537660 - DNA, 485 bp, Homo sapiens
  misc_feature: HIJSMM301C4PF7.3.42.D09.1.454.light.4.raw
agacgcactccacgaccggtgctcgatttagacacatacgcagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccaacagaaacctggccaggctcccaggctcctcattcatggtgcatctaacagggccgatggcattccagccaggttcagtggcagtggatatgggacagacttcactctcaccatcagcaatctgcagtctgaagattttgcagtttatttctgtcagcagtttaacacctggcctggaagttttggccaggggaccaagctggagctcaaacgaactgtggctgcaccat

SEQ ID NO: 537661 - DNA, 488 bp, Homo sapiens; identical to SEQ ID NO: 535081
  misc_feature: HIJSMM301CXQK9.26.23.C01.1.454.light.4.raw

SEQ ID NO: 537662 - DNA, 495 bp, Homo sapiens
  misc_feature: HIJSMM301BPQW5.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagttttaccctcacaactcatatcacagaatctgaggatgctgcattttacttcggtctacaacatgataatttcctccgtggacgttcggccaagggaccaaggagcaaatcaaacgaactgtggctgcaccatctgtcttcatcttcccgccat

SEQ ID NO: 537663 - DNA, 524 bp, Homo sapiens
  misc_feature: HIJSMM301CGBIP.12.23.C01.1.454.light.4.raw
atacgacgtacacgaccggtgctcgatttagtacacgtgattagggattgggggaggaactgctcagttaggacccagacggaaccatggaagccccacgcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggtcgggggaccgggaacggtagggtaggagtactaaaccgaaacgtagtgggtcgtcgtcgacccaactcttcgttccg

SEQ ID NO: 537664 - DNA, 492 bp, Homo sapiens; identical to SEQ ID NO: 535939
  misc_feature: HIJSMM301A3D6Y.13.5.A05.1.454.light.4.raw

SEQ ID NO: 537665 - DNA, 503 bp, Homo sapiens
  misc_feature: HIJSMM301CA6EV.48.38.D05.1.454.light.4.raw
agtatacatacacgaccggtgctcgatttagtatctgatagttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 537666 - DNA, 492 bp, Homo sapiens
  misc_feature: HIJSMM301A12D5.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccatctgtctt

SEQ ID NO: 537667 - DNA, 464 bp, Homo sapiens
  misc_feature: HIJSMM301AFZ45.48.47.E03.1.454.light.4.raw
agtatacatacacgaccggtgctcgatttagactcgcgcacagagagaaggggagagctgctcagttaggacccagagggaaccatggaacccacgcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 537668 - DNA, 485 bp, Homo sapiens; identical to SEQ ID NO: 536576
  misc_feature: HIJSMM301CC95T.46.35.D02.1.454.light.4.raw

SEQ ID NO: 537669 - DNA, 470 bp, Homo sapiens
  misc_feature: HIJSMM301BNNZY.4.75.G09.1.454.light.4.raw
agcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcactgggaccaaggtcaccgtcctaggtcagccc

SEQ ID NO: 537670 - DNA, 447 bp, Homo sapiens; identical to SEQ ID NO: 535020
  misc_feature: HIJSMM301AGAYA.18.9.A09.1.454.light.4.raw

SEQ ID NO: 537671 - DNA, 502 bp, Homo sapiens; identical to SEQ ID NO: 536253
  misc_feature: HIJSMM301D3CWI.21.22.B11.1.454.light.4.raw

SEQ ID NO: 537672 - DNA, 486 bp, Homo sapiens; identical to SEQ ID NO: 535043
  misc_feature: HIJSMM301EQR8K.46.35.D02.1.454.light.4.raw

SEQ ID NO: 537673 - DNA, 488 bp, Homo sapiens
  misc_feature: HIJSMM301CPOTI.12.31.C09.1.454.light.4.raw
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagagttaccgcgctcccatcactttcggccaagggacacgaccgcagattggacgaactgtggctgcacc

SEQ ID NO: 537674 - DNA, 497 bp, Homo sapiens; identical to SEQ ID NO: 536371
  misc_feature: HIJSMM301A0EGG.16.78.H01.1.454.light.4.raw

SEQ ID NO: 537675 - DNA, 491 bp, Homo sapiens
  misc_feature: HIJSMM301CC3Q6.5.57.F02.1.454.light.4.raw
atcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtctt

SEQ ID NO: 537676 - DNA, 472 bp, Homo sapiens
  misc_feature: HIJSMM301BY84E.4.75.G09.1.454.light.4.raw
agcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcactgggaccaaggtcaccgtcctaggtcagccccg

SEQ ID NO: 537677 - DNA, 499 bp, Homo sapiens; identical to SEQ ID NO: 536578
  misc_feature: HIJSMM301BVMD4.22.27.C05.1.454.light.4.raw

SEQ ID NO: 537678 - DNA, 477 bp, Homo sapiens
  misc_feature: HIJSMM301A03EY.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaactgtggctgcaccatctgtt

SEQ ID NO: 537679 - DNA, 490 bp, Homo sapiens
  misc_feature: HIJSMM301CBYKP.40.8.A08.1.454.light.4.raw
tctagcgactcacgaccggtgctcgatttagcatactctacagggggctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagactgttttatacagctccaacaatgagaactacgttgcttggtaccagcagaaaccaggacagcctcctaagttgctcatttactgggcatctacccgggcatccggggtccctgaccgattcagtgccagcgggtctgggacagacttcactctcaccatcagcggcctgcaggctgaagatgtggcagtttatactgtcagcactgtttggcggttctccgactttcggcggagggaccaaggtggaggtcaaacgaactgtggctgcaccat

SEQ ID NO: 537680 - DNA, 492 bp, Homo sapiens; identical to SEQ ID NO: 535126
  misc_feature: HIJSMM301DM2SD.18.11.A11.1.454.light.4.raw

SEQ ID NO: 537681 - DNA, 496 bp, Homo sapiens
  misc_feature: HIJSMM301C40IS.40.23.C01.1.454.light.4.raw
tctagcgactcacgaccggtgctcgatttagtacacgtgattagggattggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcatt

SEQ ID NO: 537682 - DNA, 513 bp, Homo sapiens; identical to SEQ ID NO: 535244
  misc_feature: HIJSMM301AKSBJ.17.33.C11.1.454.light.4.raw

SEQ ID NO: 537683 - DNA, 508 bp, Homo sapiens
  misc_feature: HIJSMM301CGYTP.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggcccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctc

SEQ ID NO: 537684 - DNA, 503 bp, Homo sapiens; identical to SEQ ID NO: 537518
  misc_feature: HIJSMM301DTIGO.8.19.B08.1.454.light.4.raw

SEQ ID NO: 537685 - DNA, 443 bp, Homo sapiens
  misc_feature: HIJSMM301D7M4F.17.21.B10.1.454.light.4.raw
cgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtggctgcaccatctgtcttcatcttccgccatctgactagtctacg

SEQ ID NO: 537686 - DNA, 489 bp, Homo sapiens
  misc_feature: HIJSMM301BN6Q6.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcgtcggagggaccgaagacggagatcagacgaactgtggcgtgcaccatctgtcttcta

SEQ ID NO: 537687 - DNA, 482 bp, Homo sapiens
  misc_feature: HIJSMM301BPQ18.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggccaaggtggagatcaaagaa

SEQ ID NO: 537688 - DNA, 446 bp, Homo sapiens
  misc_feature: HIJSMM301EPBPD.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggcaacccctctgtcactctgttcccgccctcctccatactcgta

SEQ ID NO: 537689 - DNA, 484 bp, Homo sapiens
  misc_feature: HIJSMM301AMI06.19.71.G05.1.454.light.4.raw
tactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatat

SEQ ID NO: 537690 - DNA, 501 bp, Homo sapiens
  misc_feature: HIJSMM301BCIGK.41.14.B03.1.454.light.4.raw
tctatactatcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccctc

SEQ ID NO: 537691 - DNA, 498 bp, Homo sapiens; identical to SEQ ID NO: 536173
  misc_feature: HIJSMM301A9Z4N.12.86.H09.1.454.light.4.raw

SEQ ID NO: 537692 - DNA, 488 bp, Homo sapiens
  misc_feature: HIJSMM301AH870.49.81.H04.1.454.light.4.raw
agtcgagagacacgaccggtgctcgatttagtagtgtagattcgcggggaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttctaccatcatcaacctgcagcctgaggatattgcaacatattactgtcaacagtatgataatctcccactcacttcgtcggagggacgaacggtaggaggatcaaacgaaactagtggcgtgcaccat

SEQ ID NO: 537693 - DNA, 494 bp, Homo sapiens; identical to SEQ ID NO: 534994
  misc_feature: HIJSMM301ARWH6.27.78.H01.1.454.light.4.raw

SEQ ID NO: 537694 - DNA, 481 bp, Homo sapiens
  misc_feature: HIJSMM301EPJPA.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccaaggtggatatcagacgaa

SEQ ID NO: 537695 - DNA, 488 bp, Homo sapiens
  misc_feature: HIJSMM301DKP9V.8.4.A04.1.454.light.4.raw
ctcgcgtgtccacgaccggtgctcgatttagagtagtgatcaggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggagggaa

SEQ ID NO: 537696 - DNA, 510 bp, Homo sapiens
  misc_feature: HIJSMM301DRW8J.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgccttacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaaggatgttgcagtttattactgtcaacatcgtaccgagtggcctccgggggccactttcggccctgggaccaaggtggagatcaaacgaactgtggctgcaccatctgtcttcta

SEQ ID NO: 537697 - DNA, 509 bp, Homo sapiens
  misc_feature: HIJSMM301ASUWM.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcattttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttccca

SEQ ID NO: 537698 - DNA, 510 bp, Homo sapiens
  misc_feature: HIJSMM301ASIHV.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcggtccaagggaccgaaggtggaaagtacaaacgaaacacgttggctgcgaccatctgtcttctatcttccccg

SEQ ID NO: 537699 - DNA, 505 bp, Homo sapiens
  misc_feature: HIJSMM301B04YK.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctctacgttcggacggacggacgaggcgagatacgacgaacgtacgtggtcgtcgtcgaccacctactcgttcgttctt

SEQ ID NO: 537700 - DNA, 493 bp, Homo sapiens; identical to SEQ ID NO: 536534
  misc_feature: HIJSMM301BCFH6.43.72.G06.1.454.light.4.raw

SEQ ID NO: 537701 - DNA, 495 bp, Homo sapiens
  misc_feature: HIJSMM301EP7JM.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaagggccactggcatcccagccaggttcagtggcagtgggtctggaagagacttcactctcaccatcaacagcctagagcctgacgattctgcagtttattactgtcagcagcgtaccaagtggcctccgacttttggccaggggccaagctggagatcagacgaactgtggctgcaccatctgtcttcatcttccccg

SEQ ID NO: 537702 - DNA, 505 bp, Homo sapiens; identical to SEQ ID NO: 536254
  misc_feature: HIJSMM301BLPFO.7.71.G05.1.454.light.4.raw

SEQ ID NO: 537703 - DNA, 492 bp, Homo sapiens
  misc_feature: HIJSMM301AF8BF.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatcc

SEQ ID NO: 537704 - DNA, 487 bp, Homo sapiens
  misc_feature: HIJSMM301EC4JX.47.55.E11.1.454.light.4.raw
agctcacgtacacgaccggtgctcgatttagcactcgcacgttgggtttggggagagagacccctcccctgggatcctgcagctccaggctcccgtgggtgggttagagttgggaacctatgaacattctgtaggggccactgtcttctccacggtcaccatctcttgttctggaagcagctccaatatcggaaatgataatgtatactggtaccagcaagtcccacgaacggccccaactcctcatctataacaatgatcagcggccctcagggtccctgccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtccactctgttcccaccctcctctacgtgagct

SEQ ID NO: 537705 - DNA, 505 bp, Homo sapiens
  misc_feature: HIJSMM301CUTPN.21.87.H10.1.454.light.4.raw
tcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttgcggcgggacccagatgactgtcctcagtcagcccaaggctgccccctcggt

SEQ ID NO: 537706 - DNA, 502 bp, Homo sapiens
  misc_feature: HIJSMM301B40QX.15.1.A01.1.454.light.4.raw
tctacgtagccacgaccggtgctcgatttagacgtctcatcagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactcc

SEQ ID NO: 537707 - DNA, 496 bp, Homo sapiens
  misc_feature: HIJSMM301APZPV.48.4.A04.1.454.light.4.raw
agtatacatacacgaccggtgctcgatttagagtagtgatcagggggagtcagtctcagtcaggacacagcatggacatgagggtccccgctcagctcctggggctcctgctactctggctccgaggtgccagatgtgacatccagatgacccagtctccatcatccctgtctgcatatgtgggggacagagtcaccatcacttgccgggcaagtcagagcattagtaggtatttaaattggtatcatcaaagaccagggatggcccctaacctcctgatctacggtacatccactttgcaaagtggggtcccctcaaggttcagcggcagtggctcttggacggatttcactctcaccatcaccagtcttcaggctgaagatttaggaatttactactgtcagcagacttacagtgttccgtacacttttggccaggggaccaaactggagatgaaacgaactgtggctgcacccatctgtcttcatcttccccg

SEQ ID NO: 537708 - DNA, 499 bp, Homo sapiens
  misc_feature: HIJSMM301CZM5V.12.86.H09.1.454.light.4.raw
atacgacgtacacgaccggtgctcgatttagtgctatagacttgggtttgggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagccctagagcctgaagattttgtcagtttattactgtcagcagcgtagcaactggcctcggttcacttttggccagggaccgaagctggagatcaaacgaactgtggctgcaccatctgtcttcat

SEQ ID NO: 537709 - DNA, 489 bp, Homo sapiens; identical to SEQ ID NO: 535139
  misc_feature: HIJSMM301BZLLB.14.55.E11.1.454.light.4.raw

SEQ ID NO: 537710 - DNA, 482 bp, Homo sapiens
  misc_feature: HIJSMM301CBWB1.51.64.F09.1.454.light.4.raw
cgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttctaacaacctagcctggtatcagcagaagcctggccaggctcccaggctcctcatctatggttcatccaccagggccgctgatatcccagccaggttcagtggcagtgggtctgggacagaattcactctcaccatcagcagcctgcagtctgaacattttgcagtttattactgtcagcagtatgataagtggcctccgtacacttttggccaggggaccaggctggagatcaaacgaactgtggctgcaccat

SEQ ID NO: 537711 - DNA, 507 bp, Homo sapiens
  misc_feature: HIJSMM301A7T49.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccgacaataggaactacttagcttggtaccaacagaaaccaggacagcctccgaagttactctttactgggcgtctacccgggaatccggggtccctgaccgattcagtggcagcgggtctgggacagatttcactctcaccatcagcagccttcaggctgaagatgtggcagtttattactgtcagcaatattatatctctcctcctcggacgttcggccaagggaccagggtggaaatcaaacgaactagtggctgcaccatctgttctcta

SEQ ID NO: 537712 - DNA, 504 bp, Homo sapiens
  misc_feature: HIJSMM301C8UEW.14.86.H09.1.454.light.4.raw
cgtctagtaccacgaccggtgctcgatttagtgctatagacttgggtttggggaggaactgctcagttaggacccagagggaaccatggcagccccacgctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagctccctagagcctggagattttgtagtttattactgtcagcagtatagcagctggcctcccactttcggcggagggaccaaggtggagatccaacgaactgtggctgcaccatctgtcttcatcttccccg

SEQ ID NO: 537713 - DNA, 383 bp, Homo sapiens; identical to SEQ ID NO: 447524
  misc_feature: HIJSMM301BX3A5.41.26.C04.1.454.light.4.raw

SEQ ID NO: 537714 - DNA, 475 bp, Homo sapiens
  misc_feature: HIJSMM301DP5FG.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctggactgaagtgcatatgaagagaactgtggctgca

SEQ ID NO: 537715 - DNA, 504 bp, Homo sapiens
  misc_feature: HIJSMM301A69QJ.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccggaacggtggagttctaaacgaaactagttggcgtgcgaccatcttgtcttctat

SEQ ID NO: 537716 - DNA, 495 bp, Homo sapiens
  misc_feature: HIJSMM301B11NG.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctcagacgttcggccaagggaccaaggtggaaatcaaacgaactgtggctgcacc

SEQ ID NO: 537717 - DNA, 480 bp, Homo sapiens; identical to SEQ ID NO: 535291
  misc_feature: HIJSMM301CRE6F.22.59.F04.1.454.light.4.raw

SEQ ID NO: 537718 - DNA, 509 bp, Homo sapiens
  misc_feature: HIJSMM301CHCS3.51.37.D04.1.454.light.4.raw
cgatcgtatacacgaccggtgctcgatttagtagcatactgttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatcaaacgaaactgtggctgcaccatctgtctt

SEQ ID NO: 537719 - DNA, 445 bp, Homo sapiens
  misc_feature: HIJSMM301CXUE6.47.85.H08.1.454.light.4.raw
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccaccctcctctacgtgagct

SEQ ID NO: 537720 - DNA, 494 bp, Homo sapiens; identical to SEQ ID NO: 536886
  misc_feature: HIJSMM301B5NDT.10.33.C11.1.454.light.4.raw

SEQ ID NO: 537721 - DNA, 417 bp, Homo sapiens
  misc_feature: HIJSMM301CCD6L.18.78.H01.1.454.light.4.raw
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccactgtcactctgttcccgccctcctccatactcgta

SEQ ID NO: 537722 - DNA, 506 bp, Homo sapiens
  misc_feature: HIJSMM301ETJ83.12.28.C06.1.454.light.4.raw
  modified_base (459)..(459): a, c, t, g, unknown or other
  modified_base (484)..(484): a, c, t, g, unknown or other
atacgacgtacacgaccggtgctcgatttagagctcacgtattgggtttggggagtcagtctcagtcaggacacagcatggacatgagggtccccgccccagctcctggggcgtcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtgccgaggacgaccagagaatanagacgaactacgtggctgcaccaanctgtcttctactctcccgtccc

SEQ ID NO: 537723 - DNA, 443 bp, Homo sapiens
  misc_feature: HIJSMM301DLP87.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgcccctcggtcactctgttcccaccctcctcgacacgcgag

SEQ ID NO: 537724 - DNA, 444 bp, Homo sapiens; identical to SEQ ID NO: 534993
  misc_feature: HIJSMM301BT7AL.5.9.A09.1.454.light.4.raw

SEQ ID NO: 537725 - DNA, 454 bp, Homo sapiens; identical to SEQ ID NO: 534964
  misc_feature: HIJSMM301DEVP5.19.86.H09.1.454.light.4.raw

SEQ ID NO: 537726 - DNA, 475 bp, Homo sapiens
  misc_feature: HIJSMM301DZKM3.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctccactttcggcggagggaccaaggtggagatcaaacgaactgtggctgcaccatctgt

SEQ ID NO: 537727 - DNA, 486 bp, Homo sapiens; identical to SEQ ID NO: 537238
  misc_feature: HIJSMM301CMUBL.19.71.G05.1.454.light.4.raw

SEQ ID NO: 537728 - DNA, 487 bp, Homo sapiens
  misc_feature: HIJSMM301AJ903.14.55.E11.1.454.light.4.raw
  modified_base (458)..(458): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctacttacgtcggacgggacggacgaggagantacgacgacacgtggcgctcgaccactct

SEQ ID NO: 537729 - DNA, 493 bp, Homo sapiens
  misc_feature: HIJSMM301AKHX6.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggaccgaacggtggaaagtacaaacgaaacctagttggcgtgcaccca

SEQ ID NO: 537730 - DNA, 444 bp, Homo sapiens; identical to SEQ ID NO: 535027
  misc_feature: HIJSMM301CTXNU.8.73.G07.1.454.light.4.raw

SEQ ID NO: 537731 - DNA, 494 bp, Homo sapiens
  misc_feature: HIJSMM301DUN4N.51.59.F04.1.454.light.4.raw
cgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccact

SEQ ID NO: 537732 - DNA, 483 bp, Homo sapiens; identical to SEQ ID NO: 535413
  misc_feature: HIJSMM301CQ3VL.26.78.H01.1.454.light.4.raw

SEQ ID NO: 537733 - DNA, 494 bp, Homo sapiens; identical to SEQ ID NO: 534994
  misc_feature: HIJSMM301AXH7T.27.78.H01.1.454.light.4.raw

SEQ ID NO: 537734 - DNA, 493 bp, Homo sapiens; identical to SEQ ID NO: 536769
  misc_feature: HIJSMM301BO5TT.19.83.H06.1.454.light.4.raw

SEQ ID NO: 537735 - DNA, 447 bp, Homo sapiens; identical to SEQ ID NO: 535020
  misc_feature: HIJSMM301A9G4P.18.9.A09.1.454.light.4.raw

SEQ ID NO: 537736 - DNA, 474 bp, Homo sapiens
  misc_feature: HIJSMM301DGTG9.18.59.F04.1.454.light.4.raw
tacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggccaaaccccactgtcactctgttccccaccctcctccatactcgta

SEQ ID NO: 537737 - DNA, 492 bp, Homo sapiens; identical to SEQ ID NO: 534967
  misc_feature: HIJSMM301A7BR1.47.64.F09.1.454.light.4.raw

SEQ ID NO: 537738 - DNA, 484 bp, Homo sapiens
  misc_feature: HIJSMM301BJ3H1.48.22.B11.1.454.light.4.raw
agtatacatacacgaccggtgctcgatttagacgacagctcaggggagtcagtcccagtcaggacacagcatggacatgagggtccccgctcagctcctggggctcctgctgctctggctcccaggtgccagatggtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctgaagatgttgcaacttattactgtcaacagcttagtagtaaccctccgtacacttttggccaggggaccaaggtggagatcaaacgaactgtggctgcaccatctgt

SEQ ID NO: 537739 - DNA, 499 bp, Homo sapiens
  misc_feature: HIJSMM301BD846.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcatt

SEQ ID NO: 537740 - DNA, 501 bp, Homo sapiens
  misc_feature: HIJSMM301E1IM4.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgaagattttgcagtgtattattgtcagcagtatggtagcgcaccgtacacttttggccaggggtccaagctggagatagaaacgaactgtggctgcaccatctgtcttcatcttcccg

SEQ ID NO: 537741 - DNA, 464 bp, Homo sapiens; identical to SEQ ID NO: 536640
  misc_feature: HIJSMM301CSXBN.26.78.H01.1.454.light.4.raw

SEQ ID NO: 537742 - DNA, 482 bp, Homo sapiens
  misc_feature: HIJSMM301CJ44G.51.41.D08.1.454.light.4.raw
cgatcgtatacacgaccggtgctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggagggaccaaggtggagatcaaacgaactgtggctgcaca

SEQ ID NO: 537743 - DNA, 444 bp, Homo sapiens
  misc_feature: HIJSMM301B5S6C.47.85.H08.1.454.light.4.raw
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccgcctcctctacgtgagct

SEQ ID NO: 537744 - DNA, 488 bp, Homo sapiens; identical to SEQ ID NO: 536056
  misc_feature: HIJSMM301C5HVV.47.36.D03.1.454.light.4.raw

SEQ ID NO: 537745 - DNA, 385 bp, Homo sapiens
  misc_feature: HIJSMM301CE7WT.49.87.H10.1.454.light.4.raw
agtcgagagacacgaccggtgctcgatttagcagtactgcgttgggtttggggtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 537746 - DNA, 490 bp, Homo sapiens
  misc_feature: HIJSMM301DZNCL.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtaggacgatcaagcgaactgtggctgcaccatct

SEQ ID NO: 537747 - DNA, 494 bp, Homo sapiens; identical to SEQ ID NO: 535680
  misc_feature: HIJSMM301BL5QC.16.78.H01.1.454.light.4.raw

SEQ ID NO: 537748 - DNA, 482 bp, Homo sapiens
  misc_feature: HIJSMM301CF937.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggtccaagggaccaaggtggaaatcaaacgaaactgtggctgcacca

SEQ ID NO: 537749 - DNA, 479 bp, Homo sapiens
  misc_feature: HIJSMM301DC7W0.51.78.H01.1.454.light.4.raw
cgatcgtatacacgaccggtgctcgatttagtgtgagtagtttgggtttggggctttccctggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtgggtcccatcaaggttcagtggcagtggatctgggacagatttcactctcaccatcagcagtgtgcgacctgaagattttgcaacttactactgtcaacagagttacagtacccctcagctcactttcggcggagggaccaaggtggagatcaaacgaactgtggctgcaccatctgtcttcatcttcccgccat

SEQ ID NO: 537750 - DNA, 482 bp, Homo sapiens
  misc_feature: HIJSMM301AVF1R.41.34.D01.1.454.light.4.raw
tctatactatcacgaccggtgctcgatttagatcgtctgtgttgggtttggggaggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgca

SEQ ID NO: 537751 - DNA, 496 bp, Homo sapiens
  misc_feature: HIJSMM301DP6FW.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaacgaactgtggctgcacca

SEQ ID NO: 537752 - DNA, 503 bp, Homo sapiens
  misc_feature: HIJSMM301AD22J.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatacagcagagtggaggctgaggatgttggggtttattactgcatgcaagctctacaaactaccttactactttggtccacggggaaccgaagactggagatcaaacgaaactgtggcg

SEQ ID NO: 537753 - DNA, 484 bp, Homo sapiens
  misc_feature: HIJSMM301DH4LU.41.47.E03.1.454.light.4.raw
tctatactatcacgaccggtgctcgatttagactcgcgcacagagagaaggggtgatcaggactcctcagttcaccttctcacaatgaggctccctgctcagctcctggggctgctaatgctctgggtctctggatctagtggagagattgtgatgagtcagtctccacgctccctgtccgtcacccctggagagtcggcctccatctcctgcaagtcgagtcacaacctcctgtatagtaatggatacaattatgtggattggtacgtgcagaagccagggcagtctccacaactcctcatctatttgggttctcatcgggactccggggtccctgacaggttcactggcagtggatcaggcacagattttaccctagaaatcagtagagtggaggctgaggatgttggcgactattactgcctgcaagctcggcaattcccgatcaccttcggccccgggacacgactggacattaaacgaa

SEQ ID NO: 537754 - DNA, 494 bp, Homo sapiens; identical to SEQ ID NO: 535629
  misc_feature: HIJSMM301AH7PN.4.27.C05.1.454.light.4.raw

SEQ ID NO: 537755 - DNA, 494 bp, Homo sapiens
  misc_feature: HIJSMM301BR2P8.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagaattaacgaactgtggctgcaccatctgtctt

SEQ ID NO: 537756 - DNA, 486 bp, Homo sapiens; identical to SEQ ID NO: 535043
  misc_feature: HIJSMM301D9Z28.46.35.D02.1.454.light.4.raw

SEQ ID NO: 537757 - DNA, 472 bp, Homo sapiens
  misc_feature: HIJSMM301BUEMJ.51.78.H01.1.454.light.4.raw
cgatcgtatacacgaccggtgctcgatttagtgtgagtagtttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtacccctcagctcactttcggcggagggaccaaggtggagatcaaacgaa

SEQ ID NO: 537758 - DNA, 472 bp, Homo sapiens; identical to SEQ ID NO: 535898
  misc_feature: HIJSMM301BO13J.15.8.A08.1.454.light.4.raw

SEQ ID NO: 537759 - DNA, 447 bp, Homo sapiens; identical to SEQ ID NO: 535201
  misc_feature: HIJSMM301DHQJL.18.9.A09.1.454.light.4.raw

SEQ ID NO: 537760 - DNA, 486 bp, Homo sapiens; identical to SEQ ID NO: 535290
  misc_feature: HIJSMM301EOX8T.3.12.B01.1.454.light.4.raw

SEQ ID NO: 537761 - DNA, 416 bp, Homo sapiens; identical to SEQ ID NO: 535308
  misc_feature: HIJSMM301DTCY6.16.46.E02.1.454.light.4.raw

SEQ ID NO: 537762 - DNA, 349 bp, Homo sapiens; identical to SEQ ID NO: 537129
  misc_feature: HIJSMM301AJDYN.13.11.A11.1.454.light.4.raw

SEQ ID NO: 537763 - DNA, 496 bp, Homo sapiens; identical to SEQ ID NO: 535109
  misc_feature: HIJSMM301DT1Z6.16.78.H01.1.454.light.4.raw

SEQ ID NO: 537764 - DNA, 481 bp, Homo sapiens
  misc_feature: HIJSMM301B5HLM.12.19.B08.1.454.light.4.raw
atacgacgtacacgaccggtgctcgatttagtgagtcagtaaggggcctgaagacttttttatgggctggtcgcaccctgtgcaggagtcagtctcagtcaggacacagcatggacatgagggtccccgctcagctcctggggctcctgctactctggctccgagatgtgacatccagatgacccagtctccatcctcccgtgtctgcatctgtgggagacagagtcaccatcacttgccgggcaagtcagaggattagcagttatttaaattggtgtcagcagaagccagggagagcccctaaggtcctgatctatgcttcatccagtttgcaaagtggggtcccatcaaggttcagtggcagtggatctgggacagatttcactctcaccatcagcggtctgcaacctgaagattttgcaacttacttctgtcaacagagttacaatacccctccgtcacctgcggccaagggacacgg

SEQ ID NO: 537765 - DNA, 499 bp, Homo sapiens
  misc_feature: HIJSMM301A7X17.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactgtcactcttccg

SEQ ID NO: 537766 - DNA, 353 bp, Homo sapiens
  misc_feature: HIJSMM301DWDO1.3.11.A11.1.454.light.4.raw
agacgcactccacgaccggtgctcgatttagctacgactgcagggccagtgagactgttagcagcagctacttagcctggtaccagaacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgaactgtggctgcaccatctgtcttcatcttcccgccatctgagagtgcgtct

SEQ ID NO: 537767 - DNA, 497 bp, Homo sapiens; identical to SEQ ID NO: 535664
  misc_feature: HIJSMM301D32K9.22.14.B03.1.454.light.4.raw

SEQ ID NO: 537768 - DNA, 497 bp, Homo sapiens; identical to SEQ ID NO: 535664
  misc_feature: HIJSMM301BWKDT.22.14.B03.1.454.light.4.raw

SEQ ID NO: 537769 - DNA, 444 bp, Homo sapiens; identical to SEQ ID NO: 534993
  misc_feature: HIJSMM301AEC0J.5.9.A09.1.454.light.4.raw

SEQ ID NO: 537770 - DNA, 493 bp, Homo sapiens; identical to SEQ ID NO: 537281
  misc_feature: HIJSMM301CGQXG.9.1.A01.1.454.light.4.raw

SEQ ID NO: 537771 - DNA, 486 bp, Homo sapiens
  misc_feature: HIJSMM301E3IZR.17.36.D03.1.454.light.4.raw
cgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagagtgttagcagctacttagcctggtaccaacagaaacctggccagtctcccaggctcctcatctatgatgcatccaacagggtcactggcatcccagccaggttcagtggcagtgggtctgggacagacttcattctcaccatcagcagcctagagcctgaagattttgcagtttattactgtcagcagcgtagcaactggctcatcaccttcggccaagggacacgactggagatgaaacgaactgtggctgcacca

SEQ ID NO: 537772 - DNA, 354 bp, Homo sapiens; identical to SEQ ID NO: 535026
  misc_feature: HIJSMM301BG1TO.19.22.B11.1.454.light.4.raw

SEQ ID NO: 537773 - DNA, 495 bp, Homo sapiens
  misc_feature: HIJSMM301A2V2V.41.68.G02.1.454.light.4.raw
tctatactatcacgaccggtgctcgatttagtcgatagtgaagggaaagggcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctccccactttcggtcggagggaccgaa

SEQ ID NO: 537774 - DNA, 495 bp, Homo sapiens
  misc_feature: HIJSMM301AXBQN.27.78.H01.1.454.light.4.raw
agcgtcgtctcacgaccggtgctcgatttagtgtgagtagtttgggtttggggatgagcaaaactagacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 537775 - DNA, 501 bp, Homo sapiens
  misc_feature: HIJSMM301CNN1C.48.8.A08.1.454.light.4.raw
agtatacatacacgaccggtgctcgatttagcatactctacaggggggaggaacccctcagttaggacccagagggaaccatggaagccccagctcagcttctcttcctcctgctactctggctcccaggttttaccggagagattgtgttgacacagtctccagtcaccctgtcattgtctccagggcaaagagccaccctctcctgcagggccaatgagagtattggcaacttcttaggctggtatcaacaaagcctggccaggctcccaggctcctcatctatgatgcatcccatagggccagaggcatcccagccaggttcagtggcagtgggtctgggacagacttcactctcaccatcagcaccctagaacgtgaagattttgcagtttattactgtcagcaccgtaaaacctggcctctgagtggttttggccaggggaccaagctggacatcaaacgaactgtggctgcaccatctgtcttcatcttcccgcc

SEQ ID NO: 537776 - DNA, 504 bp, Homo sapiens
  misc_feature: HIJSMM301BGMPJ.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttccgccat

SEQ ID NO: 537777 - DNA, 490 bp, Homo sapiens
  misc_feature: HIJSMM301C8896.41.44.D11.1.454.light.4.raw
tctatactatcacgaccggtgctcgatttagcgcagtacgaagggggctgcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctcccaatttctcctgagctacaagtcacagtcagatacacagcggggctctggagtccccagacgcttctctggattcaaagatgtttcggccaatgcaggcattttagtcatctctggggtccagtttgtggatgaggctgactactattgcacggtctggtacagcagcgctgtggtcttcgggcggagggaccagggtgaccgtcctaggtcaggcccaagg

SEQ ID NO: 537778 - DNA, 493 bp, Homo sapiens
  misc_feature: HIJSMM301ANYOH.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggagatcaacgaactgtggctgcaccatctgtt

SEQ ID NO: 537779 - DNA, 494 bp, Homo sapiens; identical to SEQ ID NO: 534992
  misc_feature: HIJSMM301A15JS.9.1.A01.1.454.light.4.raw

SEQ ID NO: 537780 - DNA, 495 bp, Homo sapiens
  misc_feature: HIJSMM301CYT7H.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccaagctgaccgtcctaggtcagccc

SEQ ID NO: 537781 - DNA, 493 bp, Homo sapiens
  misc_feature: HIJSMM301CW1MD.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccagggaccaagctggagatcaaacgaactgtggctgcaccatctgtctt

SEQ ID NO: 537782 - DNA, 490 bp, Homo sapiens; identical to SEQ ID NO: 535234
  misc_feature: HIJSMM301AU57O.17.21.B10.1.454.light.4.raw

SEQ ID NO: 537783 - DNA, 489 bp, Homo sapiens
  misc_feature: HIJSMM301A8EI3.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgtactttattactgtcagcaatataatgactggttctcgatcaccttcggccaagggacacgactggagattaaacgaactgtggctgcaccatctgtctt

SEQ ID NO: 537784 - DNA, 500 bp, Homo sapiens
  misc_feature: HIJSMM301EUATE.52.34.D01.1.454.light.4.raw
cgcagtacgacacgaccggtgctcgatttagatcgtctgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacggactggagattaaacgaactgtggctgcaccatctgtcttcat

SEQ ID NO: 537785 - DNA, 512 bp, Homo sapiens; identical to SEQ ID NO: 537564
  misc_feature: HIJSMM301AWDUQ.17.33.C11.1.454.light.4.raw

SEQ ID NO: 537786 - DNA, 506 bp, Homo sapiens
  misc_feature: HIJSMM301EKDGB.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaaggtggagatcaacgaactgtggctgcaccatctgtcttcta

SEQ ID NO: 537787 - DNA, 496 bp, Homo sapiens
  misc_feature: HIJSMM301AOBRU.3.12.B01.1.454.light.4.raw
agacgcactccacgaccggtgctcgatttagtagtgtagattccgcgggggaggaactgctcagttaggacccacgacggaaccatggaagccccacgcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggtcggaggggaccgaaggtaggagatacaaacgaaactagtggcgtgcaccat

SEQ ID NO: 537788 - DNA, 506 bp, Homo sapiens
  misc_feature: HIJSMM301EHF7D.53.10.A10.1.454.light.4.raw
cgcgtatacacacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatgggacagcgaaattgcggtgttcggcgggggaccgaaactagaccgtcctacggtcgagcccaacggcgtgccccctcccggtcgactctgttccccg

SEQ ID NO: 537789 - DNA, 514 bp, Homo sapiens
  misc_feature: HIJSMM301CIFX3.49.73.G07.1.454.light.4.raw
  modified_base (511)..(511): a, c, t, g, unknown or other
agtcgagagacacgaccggtgctcgatttagctctacgctcagggcacgaccggtgctcgatttagcagtactgcgttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatacacagaggaatattacggcggagggaccaagctgaccgtcctaggtnacg

SEQ ID NO: 537790 - DNA, 508 bp, Homo sapiens
  misc_feature: HIJSMM301CXCM1.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaagtggaaatcaaacgaactgtggctgcaccatctgtcttcatcttcccgccat

SEQ ID NO: 537791 - DNA, 497 bp, Homo sapiens
  misc_feature: HIJSMM301EJUGX.12.67.G01.1.454.light.4.raw
atacgacgtacacgaccggtgctcgatttagagtatacatattgggttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctcttgtcttcggaagtgggaccaaggtcaccgtcctacgtcagcccaaggccaaccca

SEQ ID NO: 537792 - DNA, 486 bp, Homo sapiens
  misc_feature: HIJSMM301AIIBL.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggaccaaggtggagatcaaacgaacg

SEQ ID NO: 537793 - DNA, 501 bp, Homo sapiens
  misc_feature: HIJSMM301EUFKD.15.37.D04.1.454.light.4.raw
tctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatattactaggtggttggcctggtatcagcagaaaccagggaaggcccctaagtccctcatcaagaaggcgtctactttagaagctggggtcccgtcaagattcagcgccggtggatctgggacagaattcactctcaccatcaacagcctggaacctgatgattttgcaacttattactgccaacactatgatactcacccgtacacttttggccaggggaccaagctggagatcaaaggaactgtggctgcaccatctgtcttcatcttcccg

SEQ ID NO: 537794 - DNA, 509 bp, Homo sapiens; identical to SEQ ID NO: 536047
  misc_feature: HIJSMM301CTRZ8.17.33.C11.1.454.light.4.raw

SEQ ID NO: 537795 - DNA, 501 bp, Homo sapiens; identical to SEQ ID NO: 536818
  misc_feature: HIJSMM301CW08H.12.82.H05.1.454.light.4.raw

SEQ ID NO: 537796 - DNA, 485 bp, Homo sapiens; identical to SEQ ID NO: 536307
  misc_feature: HIJSMM301D7IYZ.46.35.D02.1.454.light.4.raw

SEQ ID NO: 537797 - DNA, 422 bp, Homo sapiens
  misc_feature: HIJSMM301AFNLZ.9.34.D01.1.454.light.4.raw
tgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccgccctcctcagacgtatca

SEQ ID NO: 537798 - DNA, 494 bp, Homo sapiens; identical to SEQ ID NO: 534992
  misc_feature: HIJSMM301CRDQ8.9.1.A01.1.454.light.4.raw

SEQ ID NO: 537799 - DNA, 490 bp, Homo sapiens
  misc_feature: HIJSMM301CB6X6.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggacgaacggcggagatcagacgaactgtggctgcaccatctgtcttcta

SEQ ID NO: 537800 - DNA, 499 bp, Homo sapiens
  misc_feature: HIJSMM301DQPPW.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgaagattttgcagtttattactgtcagcagcgtagcatctggcctccgtacacctttggccaggggaccaagctggagatcaaacgaactgtggctgcaccatctgtcttcat

SEQ ID NO: 537801 - DNA, 510 bp, Homo sapiens
  misc_feature: HIJSMM301DH933.5.60.F05.1.454.light.4.raw
atcagacacgcacgaccggtgctcgatttagtacgtcatcagggaaagggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggctgccccctcggt

SEQ ID NO: 537802 - DNA, 472 bp, Homo sapiens
  misc_feature: HIJSMM301BC8ND.51.78.H01.1.454.light.4.raw
cgatcgtatacacgaccggtgctcgatttagtgtgagtagtttgggtttggggagtcagtctcagtcaggacacagcatggacatgagggtccccgcctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtacccctcagctcactttcggcggagggaccaaggtggagatcaaacgaa

SEQ ID NO: 537803 - DNA, 494 bp, Homo sapiens; identical to SEQ ID NO: 535629
  misc_feature: HIJSMM301CK43E.4.27.C05.1.454.light.4.raw

SEQ ID NO: 537804 - DNA, 477 bp, Homo sapiens
  misc_feature: HIJSMM301DY6VD.7.81.H04.1.454.light.4.raw
  modified_base (475)..(475): a, c, t, g, unknown or other
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaagcccctaaactcctgatctctgctgccgccagtttgcaaagtggggtcccatcaagattcagtggcagtggatctgggacagatttcactctcgccatcagtagtctgcaactgatgattttgcaacttactactgtcaaacaggattccactaccccaatccactttcggccctgggactgaagtgcatatcgaagagaactgtggctnca

SEQ ID NO: 537805 - DNA, 494 bp, Homo sapiens
  misc_feature: HIJSMM301AKVJL.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcactcttcg

SEQ ID NO: 537806 - DNA, 497 bp, Homo sapiens; identical to SEQ ID NO: 536371
  misc_feature: HIJSMM301B7N75.16.78.H01.1.454.light.4.raw

SEQ ID NO: 537807 - DNA, 511 bp, Homo sapiens
  misc_feature: HIJSMM301B8LVZ.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctccacttcgtcggacgggacgacgggtagggaggagtacaaacgaactaacgtggcgtcgcgaccactacctgttcttctact

SEQ ID NO: 537808 - DNA, 497 bp, Homo sapiens
  misc_feature: HIJSMM301AUC1K.41.35.D02.1.454.light.4.raw
tctatactatcacgaccggtgctcgatttagcacacgatagttgggtttggggtgctcgattagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaccaggaaagccctaaactccttatttatggatcatccagtttacaaagtggggtcccatcaaggttcagcggcagtggatctgggacacatttcactctcactatcagcagcctgcagccctgaggattttgcgacttactattgtcaacaggctgacagtttccctctcactttcggcggaggaccaagttgagacaaacgaa

SEQ ID NO: 537809 - DNA, 420 bp, Homo sapiens
  misc_feature: HIJSMM301BBOJE.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagccccaaaggcccaaccccactgtcactctgttccccaccctcctccatactcgta

SEQ ID NO: 537810 - DNA, 508 bp, Homo sapiens
  misc_feature: HIJSMM301AW2QO.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagcccaaggctgccccctcggtcactctgttccccg

SEQ ID NO: 537811 - DNA, 483 bp, Homo sapiens
  misc_feature: HIJSMM301AN7V4.49.35.D02.1.454.light.4.raw
agtcgagagacacgaccggtgctcgatttagcacacgatagttgggtttggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttctaccatcagcagactgcagcctgaagatattgcaacatattactgtcaacagtatgatagtctcccgcctcactttcggtcggaggggaccaacggtaggagatcaaacgaaactgtggcg

SEQ ID NO: 537812 - DNA, 476 bp, Homo sapiens
  misc_feature: HIJSMM301CTLRQ.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggagatcaaacgaactgtggctgca

SEQ ID NO: 537813 - DNA, 434 bp, Homo sapiens; identical to SEQ ID NO: 535153
  misc_feature: HIJSMM301EXCXX.18.5.A05.1.454.light.4.raw

SEQ ID NO: 537814 - DNA, 483 bp, Homo sapiens
  misc_feature: HIJSMM301EZEMR.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtcagcccc

SEQ ID NO: 537815 - DNA, 492 bp, Homo sapiens; identical to SEQ ID NO: 535426
  misc_feature: HIJSMM301C2QAT.47.78.H01.1.454.light.4.raw

SEQ ID NO: 537816 - DNA, 502 bp, Homo sapiens
  misc_feature: HIJSMM301D73G2.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtca

SEQ ID NO: 537817 - DNA, 477 bp, Homo sapiens; identical to SEQ ID NO: 535122
  misc_feature: HIJSMM301AYVTI.26.72.G06.1.454.light.4.raw

SEQ ID NO: 537818 - DNA, 494 bp, Homo sapiens
  misc_feature: HIJSMM301CHKSJ.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggagatcaaacgaactgtggctgcaccattctgtct

SEQ ID NO: 537819 - DNA, 481 bp, Homo sapiens
  misc_feature: HIJSMM301BL41O.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgctagtttattactgtcagcactataataactggcctccgtacagttttggccaggggaccaagctggagatcaaacgaa

SEQ ID NO: 537820 - DNA, 497 bp, Homo sapiens; identical to SEQ ID NO: 536371
  misc_feature: HIJSMM301B3811.16.78.H01.1.454.light.4.raw

SEQ ID NO: 537821 - DNA, 492 bp, Homo sapiens
  misc_feature: HIJSMM301EKJ3G.12.23.C01.1.454.light.4.raw
atacgacgtacacgaccggtgctcgatttagtacacgtgattagggattggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggagatcaaacgaactgtggctgcaccatctgt

SEQ ID NO: 537822 - DNA, 497 bp, Homo sapiens
  misc_feature: HIJSMM301EE148.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccgccctcctc

SEQ ID NO: 537823 - DNA, 494 bp, Homo sapiens; identical to SEQ ID NO: 535276
  misc_feature: HIJSMM301D8ZCI.16.6.A06.1.454.light.4.raw

SEQ ID NO: 537824 - DNA, 491 bp, Homo sapiens; identical to SEQ ID NO: 535294
  misc_feature: HIJSMM301CV618.16.68.G02.1.454.light.4.raw

SEQ ID NO: 537825 - DNA, 499 bp, Homo sapiens; identical to SEQ ID NO: 537739
  misc_feature: HIJSMM301BQBDR.12.86.H09.1.454.light.4.raw

SEQ ID NO: 537826 - DNA, 516 bp, Homo sapiens
  misc_feature: HIJSMM301DQ3JG.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaacgggaccgaacggtaggaagtacgaaacgaactacgtggctgcaccactctgtcttctatcttcccgcccact

SEQ ID NO: 537827 - DNA, 490 bp, Homo sapiens
  misc_feature: HIJSMM301C53MG.51.37.D04.1.454.light.4.raw
cgatcgtatacacgaccggtgctcgatttagtagcatactgttgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccgaagctgaccgtcctcggtcagcccaaggctgcccctcggt

SEQ ID NO: 537828 - DNA, 497 bp, Homo sapiens; identical to SEQ ID NO: 536376
  misc_feature: HIJSMM301CO7PH.22.9.A09.1.454.light.4.raw

SEQ ID NO: 537829 - DNA, 500 bp, Homo sapiens
  misc_feature: HIJSMM301DF2ON.4.39.D06.1.454.light.4.raw
agcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgcccctc

SEQ ID NO: 537830 - DNA, 502 bp, Homo sapiens; identical to SEQ ID NO: 536253
  misc_feature: HIJSMM301AZM3R.21.22.B11.1.454.light.4.raw

SEQ ID NO: 537831 - DNA, 491 bp, Homo sapiens
  misc_feature: HIJSMM301D98I8.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtggaggatcaaacgaactgtggctgcaccaat

SEQ ID NO: 537832 - DNA, 484 bp, Homo sapiens; identical to SEQ ID NO: 535211
  misc_feature: HIJSMM301CDOX3.47.46.E02.1.454.light.4.raw

SEQ ID NO: 537833 - DNA, 494 bp, Homo sapiens
  misc_feature: HIJSMM301DC6TE.13.39.D06.1.454.light.4.raw
tcacgtactacacgaccggtgctcgatttagtgacatctcgcagttctttggggtgctggggtctcaggaggcagcgctctcaggacatctccaccatggcctgggctctgctgctcctcaccctcctcactcagggcaaagggtcctgggcccagtctgccctgactcagcctgcctccgtgtctggctctcctggacagtcgatcatcgtctcctgcactggaaccagcactgatgttggtggttataactatgtctcctggtatcaacaacacccaggcaaagcccccaaactcatcatttatgaagtcatttatcggccctcagggatttctaatcgcttctctggctccaagtctggcaacacggcctccctgaccatctctgggctccaggctgaagacgaggctgattattactgcggctcctggacgattagcaccctttatgtcttcgggactgtgaccaaggtcaccgtcctaggtcagcccaa

SEQ ID NO: 537834 - DNA, 493 bp, Homo sapiens
  misc_feature: HIJSMM301AZZPE.46.35.D02.1.454.light.4.raw
  modified_base (463)..(463): a, c, t, g, unknown or other
actagcagtacacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaacgaaattttggtcacgggacggaacgactggnggatcaaacgaaactagtggcgtgcaccat

SEQ ID NO: 537835 - DNA, 486 bp, Homo sapiens
  misc_feature: HIJSMM301DZ4G1.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctctagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaaagggacacgactggagattaaaacgaactgtggctgcaccat

SEQ ID NO: 537836 - DNA, 479 bp, Homo sapiens
  misc_feature: HIJSMM301AGD2Z.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggctagtttattactgtcagcagtattgtgaagctccgctcactttcggcggagggaccgcggtggagatcagacgaactgtggctgcaccatctgtctt

SEQ ID NO: 537837 - DNA, 497 bp, Homo sapiens
  misc_feature: HIJSMM301B686Z.41.3.A03.1.454.light.4.raw
tctatactatcacgaccggtgctcgatttagagagcgtcacaggggagagctgctcagttaggacccagagggaaccatggaaaccccagcgcagcttctcttcctcctgctactctggctcccaggtgccaccggagaaattgtgttgacgcagtctccaggcaccctgtctttctctccaggggaaagagccaccctctcctgcagggccagtcagagtgttgacaaccagtacttcgcctggtaccagcagaaacctggccaggctcccaggctcctcatggatggtgcatccagcagggccactggcatcccagacaggttcggtggcagtgggtctgggacagacttcactctcaccatcagcagcctggagcctgaagattttgtagtgtattactgtcagcagtatcttacaacaccggggattttggccaggggaccaagctggagatcaaacgaactgtggctgcaccatctgtcttcatcttccccg

SEQ ID NO: 537838 - DNA, 517 bp, Homo sapiens
  misc_feature: HIJSMM301A55YN.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaaggaccaaggtggcaatcaaccgaactgtggctgcaccatctgtcttcatcttccccg

SEQ ID NO: 537839 - DNA, 494 bp, Homo sapiens; identical to SEQ ID NO: 534994
  misc_feature: HIJSMM301DELU6.27.78.H01.1.454.light.4.raw

SEQ ID NO: 537840 - DNA, 486 bp, Homo sapiens
  misc_feature: HIJSMM301C9Y5Q.40.81.H04.1.454.light.4.raw
tctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtgg

SEQ ID NO: 537841 - DNA, 503 bp, Homo sapiens
  misc_feature: HIJSMM301EYQPQ.48.71.G05.1.454.light.4.raw
agtatacatacacgaccggtgctcgatttagtgtcgtcgcaagagagagggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgttttctgtcagcagtatggaagttcacctcggacattcggccaggggaccaaggtggaaatcaaacgaactgtggctgcaccatctgtcttcatcttcccg

SEQ ID NO: 537842 - DNA, 479 bp, Homo sapiens
  misc_feature: HIJSMM301C0OW0.40.59.F04.1.454.light.4.raw
tctagcgactcacgaccggtgctcgatttagtacacacacttagggattggggggccgtcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaagg

SEQ ID NO: 537843 - DNA, 444 bp, Homo sapiens; identical to SEQ ID NO: 535594
  misc_feature: HIJSMM301ALT4T.9.9.A09.1.454.light.4.raw

SEQ ID NO: 537844 - DNA, 487 bp, Homo sapiens; identical to SEQ ID NO: 536206
  misc_feature: HIJSMM301ANDGP.47.38.D05.1.454.light.4.raw

SEQ ID NO: 537845 - DNA, 493 bp, Homo sapiens; identical to SEQ ID NO: 537281
  misc_feature: HIJSMM301BGNFP.9.1.A01.1.454.light.4.raw

SEQ ID NO: 537846 - DNA, 505 bp, Homo sapiens
  misc_feature: HIJSMM301AE5YO.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccacttcggcccgtcggaccgaaacgtggagatcaaacgaactagtggctgcacca

SEQ ID NO: 537847 - DNA, 485 bp, Homo sapiens; identical to SEQ ID NO: 536075
  misc_feature: HIJSMM301ASURI.17.21.B10.1.454.light.4.raw

SEQ ID NO: 537848 - DNA, 489 bp, Homo sapiens
  misc_feature: HIJSMM301EKFFD.51.67.G01.1.454.light.4.raw
cgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattacttgtcaacagtatgatagtctcccgctcactttcggtcgggggaccggaacgtaggtaggatacaacgacgaccgtaagtggcgtgcga

SEQ ID NO: 537849 - DNA, 505 bp, Homo sapiens; identical to SEQ ID NO: 535987
  misc_feature: HIJSMM301AKK1R.18.37.D04.1.454.light.4.raw

SEQ ID NO: 537850 - DNA, 475 bp, Homo sapiens
  misc_feature: HIJSMM301ANR68.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagccc

SEQ ID NO: 537851 - DNA, 500 bp, Homo sapiens
  misc_feature: HIJSMM301B2E7U.52.37.D04.1.454.light.4.raw
cgcagtacgacacgaccggtgctcgatttagtagcatactgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatt

SEQ ID NO: 537852 - DNA, 521 bp, Homo sapiens
  misc_feature: HIJSMM301BX6TM.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtctaggtcacgccaaggctgccccctcggtcactctgttcccgccct

SEQ ID NO: 537853 - DNA, 498 bp, Homo sapiens
  misc_feature: HIJSMM301AUCUH.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctgggggcagacttcactctcaccatcagcagcctagagcctgaagattttgcagtttattactgtcagcagcgtagcaactggcctcggttcacttttggccaggggaccaagctggagatcaacgaactgtggctgcaccatctgtcttcat

SEQ ID NO: 537854 - DNA, 480 bp, Homo sapiens
  misc_feature: HIJSMM301BO8BQ.41.17.B06.1.454.light.4.raw
tctatactatcacgaccggtgctcgatttagtcgatagtgaagggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggctaggctcccaggctcctcatctatgctgcatccaccagggccactggtatcccagccaggttcagtggcggtgggtctgggacagagtttactctcaccatcaacggcctgcagtctgaagattctgcagtttattactgtcagcagtatgttgactggcctccgctcactttcggcggagggaccaaggtggagatcagacgaactgtggctgcacc

SEQ ID NO: 537855 - DNA, 494 bp, Homo sapiens; identical to SEQ ID NO: 534992
  misc_feature: HIJSMM301EJ5YA.9.1.A01.1.454.light.4.raw

SEQ ID NO: 537856 - DNA, 467 bp, Homo sapiens
  misc_feature: HIJSMM301CC7V4.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 537857 - DNA, 499 bp, Homo sapiens
  misc_feature: HIJSMM301EJX3N.52.34.D01.1.454.light.4.raw
cgcagtacgacacgaccggtgctcgatttagatcgtctgtgttgggtttggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatt

SEQ ID NO: 537858 - DNA, 510 bp, Homo sapiens
  misc_feature: HIJSMM301DVSF8.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaaggctgaccgtcctcggtcagcccaaggctgccccccg

SEQ ID NO: 537859 - DNA, 497 bp, Homo sapiens
  misc_feature: HIJSMM301EGNWD.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaactgtggctga

SEQ ID NO: 537860 - DNA, 444 bp, Homo sapiens; identical to SEQ ID NO: 534993
  misc_feature: HIJSMM301BUX99.5.9.A09.1.454.light.4.raw

SEQ ID NO: 537861 - DNA, 488 bp, Homo sapiens
  misc_feature: HIJSMM301APTW0.51.60.F05.1.454.light.4.raw
cgatcgtatacacgaccggtgctcgatttagtacgtcatcagggaaaggggatataaaatctgtgctgtcaaactgattaggaactgactaccacctgcaggtcagggccaaggttatggggtcccaggttcacctcctcagcttcctcctcctttggatctctgtcagatagcagggcagaaacgacactcacgcagtctccagcattcatgtcagcgactcgaggagacaaagtcaacatctcctgcaaagccagccaggacattgatgatgatatcaactggatccaacagaaaccaggagaggctggtattttcaatattcaagaacctactactctcgttcctggaatcccacctcgattcagtggcagcgggtatggaacagattttaccctcacaattaataacatagaatctgaggatgctgcatattacttctgtctacaacatgataatttcctcggcacttttggccagggaccaag

SEQ ID NO: 537862 - DNA, 497 bp, Homo sapiens
  misc_feature: HIJSMM301BY2PA.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacaggtggggtcccgtcaaggttcagtggcagtggatctgggacagatttcactctcaccgtcagcagtctgcaacctgaagattttgcaacttactactgtcaacagagttacacgtacccccctctactttcggcggagggaccgaaggacggagatcgagacgaactggtggcgtcgcaccatctgtcttct

SEQ ID NO: 537863 - DNA, 446 bp, Homo sapiens
  misc_feature: HIJSMM301DDZ7N.14.76.G10.1.454.light.4.raw
cgtctagtaccacgaccggtgctcgatttagtcactcatacagggtcctgggcccagtctgtgctgactcagccaccctcagcgtctgggccccccggcagagggtctccatctcttgttctggagtcacttccaacatcggaaataatgatgtgagctggtaccagcaggtcccaggaacggcccccaaactctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatgggcaattgggtattcgggcggagggaccaagtttgaccgtcctaagtcagcccaaggctgccccctcggtcactctgttccccgccctcctcgtactagacg

SEQ ID NO: 537864 - DNA, 494 bp, Homo sapiens; identical to SEQ ID NO: 535680
  misc_feature: HIJSMM301AU71V.16.78.H01.1.454.light.4.raw

SEQ ID NO: 537865 - DNA, 485 bp, Homo sapiens
  misc_feature: HIJSMM301AE520.52.83.H06.1.454.light.4.raw
cgcagtacgacacgaccggtgctcgatttagatcacgtgcgtcgcggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcggcggagggaccaaggtcgagatcaaacgaactgtggctgcaccatctgtcttcat

SEQ ID NO: 537866 - DNA, 486 bp, Homo sapiens; identical to SEQ ID NO: 535043
  misc_feature: HIJSMM301EM8F6.46.35.D02.1.454.light.4.raw

SEQ ID NO: 537867 - DNA, 485 bp, Homo sapiens; identical to SEQ ID NO: 536075
  misc_feature: HIJSMM301BVT2D.17.21.B10.1.454.light.4.raw

SEQ ID NO: 537868 - DNA, 478 bp, Homo sapiens
  misc_feature: HIJSMM301BYQNT.51.37.D04.1.454.light.4.raw
cgatcgtatacacgaccggtgctcgatttagtagcatactgttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccgaaggtggaggatcaagacgaactgtggctgcga

SEQ ID NO: 537869 - DNA, 486 bp, Homo sapiens; identical to SEQ ID NO: 535523
  misc_feature: HIJSMM301CV9DN.22.73.G07.1.454.light.4.raw

SEQ ID NO: 537870 - DNA, 514 bp, Homo sapiens
  misc_feature: HIJSMM301AK1K0.13.53.E09.1.454.light.4.raw
  modified_base (463)..(463): a, c, t, g, unknown or other
  modified_base (486)..(486): a, c, t, g, unknown or other
  modified_base (493)..(493): a, c, t, g, unknown or other
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccacggacgacgacggaagaanacgacgacgacgtagtcgtgtcncacactntcgtctctacttccttccccg

SEQ ID NO: 537871 - DNA, 508 bp, Homo sapiens
  misc_feature: HIJSMM301CROOZ.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaactgtggctgcaccatctgtcttcta

SEQ ID NO: 537872 - DNA, 489 bp, Homo sapiens
  misc_feature: HIJSMM301AH52T.10.28.C06.1.454.light.4.raw
catagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccaagggggacgggatccctgatcgtttttctagggtccagctctggggcgtgagcgctacctcaccatctccagcctccagtctgaggatgaggctgactattacttgtcagacctggggcactggttatgtggttttcgggcggagggaccaagctgaccgtcctaggtcagcccaaggctcg

SEQ ID NO: 537873 - DNA, 498 bp, Homo sapiens
  misc_feature: HIJSMM301AQNIZ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctctacttcgtcggacgggacgaacgaggaggatcagacgaactacgtggcgtgcaccaactctcgttcttcta

SEQ ID NO: 537874 - DNA, 485 bp, Homo sapiens
  misc_feature: HIJSMM301AVVXK.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcaccatctgtcttcatcttcctcgccatctgactagtctacg

SEQ ID NO: 537875 - DNA, 482 bp, Homo sapiens
  misc_feature: HIJSMM301D7SLT.4.36.D03.1.454.light.4.raw
agcactgtagcacgaccggtgctcgatttagctgcgtcacgatctctcttggggagtcagactcagtcaggacacagcatggacttgagggtccccgctcagctcctggggctcctgctgctctggctcccaggtgccaaatgtgacatccagatgacccagtctccttccaccctgtctgcatctgtgggggacagagtcaccatcacttgccgggccagtcagagtgttgataactggttggcctggtatcagcagaaaccagggaaagcccctaaactcctgatttatgatgcctccggtttggaaagtggggtcccatcaaggttcagcggcagtggatctgggacagaattcactctcaccatcagcagcctgcagcctgatgattttgcaacttattactgccaacagtattatagttattctttgacgttggccaaggaccaaggtggaaatcaaacgaactgtggctgcaccat

SEQ ID NO: 537876 - DNA, 505 bp, Homo sapiens
  misc_feature: HIJSMM301CA2HB.5.68.G02.1.454.light.4.raw
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagatttttataagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcagcccaaggctgccccctcggtcactctgttcccaccctcctccgtgt

SEQ ID NO: 537877 - DNA, 504 bp, Homo sapiens; identical to SEQ ID NO: 535561
  misc_feature: HIJSMM301B22S7.4.57.F02.1.454.light.4.raw

SEQ ID NO: 537878 - DNA, 484 bp, Homo sapiens
  misc_feature: HIJSMM301ET8W2.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcaccatctgtcttcatcttcccgccatctgactagtctacg

SEQ ID NO: 537879 - DNA, 484 bp, Homo sapiens; identical to SEQ ID NO: 535441
  misc_feature: HIJSMM301B6GD7.26.60.F05.1.454.light.4.raw

SEQ ID NO: 537880 - DNA, 512 bp, Homo sapiens
  misc_feature: HIJSMM301A1ZYA.14.55.E11.1.454.light.4.raw
  modified_base (426)..(426): a, c, t, g, unknown or other
cgtctagtaccacgaccggtgctcgatttagcactcgcacgttgggtttgggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtccccgtcaaggttcagtggcagtggatctggggacagatttcactctcaccgtcagcagtctgcaacctgaagattttgtcaacttactactgtcaacagagttacagtaccccnccctctacgtcggtcgggacggacggaacggacggagatacacgaacgaaccgtaggtcggtcgtcaccacctactcgttcttctt

SEQ ID NO: 537881 - DNA, 505 bp, Homo sapiens
  misc_feature: HIJSMM301CYU9C.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccgaaggtggaaatcaaacgaactagtggctgcaccatctgtcttcatcttccccg

SEQ ID NO: 537882 - DNA, 491 bp, Homo sapiens
  misc_feature: HIJSMM301ARVD5.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccaaggacggagatcagacgaactgtggctgcaccactctgtcttcta

SEQ ID NO: 537883 - DNA, 494 bp, Homo sapiens
  misc_feature: HIJSMM301C4E3D.15.58.F03.1.454.light.4.raw
tctacgtagccacgaccggtgctcgatttagtctgatcgagaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcacagcaactggttactctctttcggcggagggaccaaggtggagatcaaacgaactgtggctgcaccatctgtcttc

SEQ ID NO: 537884 - DNA, 502 bp, Homo sapiens
  misc_feature: HIJSMM301BHTZK.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaaactgtggctgcaccatctgtcttcatcttcccgtcca

SEQ ID NO: 537885 - DNA, 481 bp, Homo sapiens
  misc_feature: HIJSMM301DQKJT.11.17.B06.1.454.light.4.raw
cgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaaggtggaaatcaaacgaactagtggctgcacca

SEQ ID NO: 537886 - DNA, 386 bp, Homo sapiens
  misc_feature: HIJSMM301BFDP2.12.41.D08.1.454.light.4.raw
atacgacgtacacgaccggtgctcgatttagtcacgcgagaaagggaaaggggaaagagccgaccctctcctgcagggccagtcagagtattagcaccaacctagcctggtatcaggagaaacctggccagactcccagacttctcatctatgctgcatcctccaggtccactgacatcccagacaggttcgagtggcagtgggtctgggacagacttcactctcaccatcaccagactgcagtctgatgattttgcactttattactgtcagcactataataattggcctccggagtacacctttggccaggggaccaagctggagatcaaacgaactgtggctgcaccatctgtcttcatcttccgccatctgatacgtcgtat

SEQ ID NO: 537887 - DNA, 473 bp, Homo sapiens
  misc_feature: HIJSMM301AEYUK.52.59.F04.1.454.light.4.raw
cgcagtacgacacgaccggtgctcgatttagtacacacacttagggattggggaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcagtgggtctgggacagattttactctcaccatcagcagcctgcagcctgaagatgttgcaacttatttctgtcataactatgatgatgcccctcacacgttcggccaagggaccaagctggaaatcaaacgaactgtggctgcaccatctgt

SEQ ID NO: 537888 - DNA, 511 bp, Homo sapiens
  misc_feature: HIJSMM301CE4UF.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccaaggaccgaacggtaggaagtacaacgaactagtggcgtgcaccaatctgtcttctatcttcccgccact

SEQ ID NO: 537889 - DNA, 462 bp, Homo sapiens
  misc_feature: HIJSMM301CQ31G.52.8.A08.1.454.light.4.raw
cgcagtacgacacgaccggtgctcgatttagcatactctacagggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggccgaaggtggagatcaagcgaa

SEQ ID NO: 537890 - DNA, 467 bp, Homo sapiens
  misc_feature: HIJSMM301BQV8F.3.68.G02.1.454.light.4.raw
agacgcactccacgaccggtgctcgatttagtcgatagtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagtgttagcagctatttaaattggtatcagcagaaaccagggaaagcccctaagctcctgatctatgctgcatccactttgcatggtggggtcccatcaagcttcagtggcagtggatctgggacagatttcactctcaccatcagcaatctgcaacctgaagattttgcaacttactactgtcaacagagttacagtacccctccgacttttggccagggaccaagctggagatcaaacgaa

SEQ ID NO: 537891 - DNA, 484 bp, Homo sapiens
  misc_feature: HIJSMM301BAHUU.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtcagccccg

SEQ ID NO: 537892 - DNA, 421 bp, Homo sapiens
  misc_feature: HIJSMM301BY72Y.41.15.B04.1.454.light.4.raw
tctatactatcacgaccggtgctcgatttagacagtatatatccgcgggcacgaccggtgctcgatttagtctagcgactttgggtttggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 537893 - DNA, 484 bp, Homo sapiens
  misc_feature: HIJSMM301DC7UQ.5.42.D09.1.454.light.4.raw
atcagacacgcacgaccggtgctcgatttagacacatacgcagggaaagggggagtcagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagagttcactctcacaatcagcagcctgcagcctgatgatcttggaacttattactgccaacaatataatagttattggacgttcggccaggggacgaaggtcgaaatgagacgaactgtggctgcacatctgtt

SEQ ID NO: 537894 - DNA, 488 bp, Homo sapiens; identical to SEQ ID NO: 536554
  misc_feature: HIJSMM301CTXGI.26.37.D04.1.454.light.4.raw

SEQ ID NO: 537895 - DNA, 484 bp, Homo sapiens; identical to SEQ ID NO: 536393
  misc_feature: HIJSMM301C1U6G.4.41.D08.1.454.light.4.raw

SEQ ID NO: 537896 - DNA, 383 bp, Homo sapiens; identical to SEQ ID NO: 447524
  misc_feature: HIJSMM301CN4G7.41.26.C04.1.454.light.4.raw

SEQ ID NO: 537897 - DNA, 517 bp, Homo sapiens; identical to SEQ ID NO: 536980
  misc_feature: HIJSMM301DM882.5.27.C05.1.454.light.4.raw

SEQ ID NO: 537898 - DNA, 503 bp, Homo sapiens
  misc_feature: HIJSMM301B4UF8.2.21.B10.1.454.light.4.raw
acgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgcccctcggtcact

SEQ ID NO: 537899 - DNA, 503 bp, Homo sapiens; identical to SEQ ID NO: 537216
  misc_feature: HIJSMM301AJL2U.3.70.G04.1.454.light.4.raw

SEQ ID NO: 537900 - DNA, 494 bp, Homo sapiens; identical to SEQ ID NO: 534994
  misc_feature: HIJSMM301EPKR5.27.78.H01.1.454.light.4.raw

SEQ ID NO: 537901 - DNA, 502 bp, Homo sapiens
  misc_feature: HIJSMM301D6DKR.19.67.G01.1.454.light.4.raw
  modified_base (422)..(422): a, c, t, g, unknown or other
tactctcgtgcacgaccggtgctcgatttagagtatacatattgggtttggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattacngtcagcaatatttttctatcctccgtggacgttcggccaagggaccagggtggaaatcagacgaactgtggctgcaccat

SEQ ID NO: 537902 - DNA, 510 bp, Homo sapiens
  misc_feature: HIJSMM301DCB6Y.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctttcccaccctcctcgctacgtaga

SEQ ID NO: 537903 - DNA, 510 bp, Homo sapiens
  misc_feature: HIJSMM301E4DX6.48.11.A11.1.454.light.4.raw
agtatacatacacgaccggtgctcgatttagctacgactgcaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccaccctcct

SEQ ID NO: 537904 - DNA, 485 bp, Homo sapiens; identical to SEQ ID NO: 534977
  misc_feature: HIJSMM301CNA68.15.28.C06.1.454.light.4.raw

SEQ ID NO: 537905 - DNA, 483 bp, Homo sapiens
  misc_feature: HIJSMM301BVC7K.5.15.B04.1.454.light.4.raw
atcagacacgcacgaccggtgctcgatttagacagtatatatccgcgggggtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggccaagggaccaaggtggaaaatcaaaacgaaaccgtggtcgtgtcgaccac

SEQ ID NO: 537906 - DNA, 489 bp, Homo sapiens
  misc_feature: HIJSMM301AMGNH.21.55.E11.1.454.light.4.raw
tcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaactacctttttaaattggtatcagcacaaaccagggaacggccccaaagctcctgatcgatgctgcatccaatttagagaggtggggtcccatccaggttcagtggcgatggatctgggacaaatttcactctcaccatcagcagtctgcaacctgaagattttgcaacttactattgtcaacagagttacagtattccttcactttcggccctggaccgaagtcgatatcaaacgaactgtggctgcaccatctgtt

SEQ ID NO: 537907 - DNA, 451 bp, Homo sapiens
  misc_feature: HIJSMM301BAPJD.52.72.G06.1.454.light.4.raw
cgcagtacgacacgaccggtgctcgatttagctacgactgcaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtcactctgttcccaccctcctctatacgatcg

SEQ ID NO: 537908 - DNA, 463 bp, Homo sapiens
  misc_feature: HIJSMM301D475C.51.1.A01.1.454.light.4.raw
cgatcgtatacacgaccggtgctcgatttagacgtctcatcagggggagtcagtcccaacccaggacacagcatggacatgagggtccctgctcagctcctggggcgtcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttcactttcaccatcagcagactgcagcctgaagatattgcaacatattactgtcaacagtatgataatctcccgctcactttcggcggaggaccgaagtggggatcaaacgaa

SEQ ID NO: 537909 - DNA, 483 bp, Homo sapiens
  misc_feature: HIJSMM301AJQAN.49.81.H04.1.454.light.4.raw
  modified_base (473)..(473): a, c, t, g, unknown or other
agtcgagagacacgaccggtgctcgatttagtagtgtagattcgcgggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttctaccatcatcaacctgcagcctgaggatattgcaacatattactgtcaacaatatgataatctaccactcacttcggtcggaggacgaccgtggagatcaacgaaactgtggcngcaccactct

SEQ ID NO: 537910 - DNA, 505 bp, Homo sapiens; identical to SEQ ID NO: 535503
  misc_feature: HIJSMM301BEJHM.8.28.C06.1.454.light.4.raw

SEQ ID NO: 537911 - DNA, 484 bp, Homo sapiens; identical to SEQ ID NO: 535240
  misc_feature: HIJSMM301C751A.47.60.F05.1.454.light.4.raw

SEQ ID NO: 537912 - DNA, 493 bp, Homo sapiens
  misc_feature: HIJSMM301DSGLM.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaactgtggc

SEQ ID NO: 537913 - DNA, 471 bp, Homo sapiens
  misc_feature: HIJSMM301ANRQI.49.22.B11.1.454.light.4.raw
agtcgagagacacgaccggtgctcgatttagacgacagctcagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccaaggtggagatcaaacgaactagt

SEQ ID NO: 537914 - DNA, 498 bp, Homo sapiens; identical to SEQ ID NO: 535295
  misc_feature: HIJSMM301DDG3Y.15.25.C03.1.454.light.4.raw

SEQ ID NO: 537915 - DNA, 486 bp, Homo sapiens; identical to SEQ ID NO: 535043
  misc_feature: HIJSMM301EGYI8.46.35.D02.1.454.light.4.raw

SEQ ID NO: 537916 - DNA, 479 bp, Homo sapiens
  misc_feature: HIJSMM301AGAJ5.4.42.D09.1.454.light.4.raw
agcactgtagcacgaccggtgctcgatttagacacatacgcagggggaacgtgctcagttaggacccacgacggaaccatggaagccccacgcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccagcagaaacctggccaggctcccaggctcctcattcatggcgcatctaacagggccgatggcatcccagccaggttcagtggcagtggatatgggacagacttcactctcaccatcagcagtctgcagtctgaagattttgcagtttatttctgtcagcagtttaacacctggcctggaagttttggccaggggaccaagctggagctcaaacgaactgtggctgcaccat

SEQ ID NO: 537917 - DNA, 507 bp, Homo sapiens
  misc_feature: HIJSMM301D7RVO.4.57.F02.1.454.light.4.raw
agcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactctgttccca

SEQ ID NO: 537918 - DNA, 489 bp, Homo sapiens; identical to SEQ ID NO: 535386
  misc_feature: HIJSMM301EEDBN.12.51.E07.1.454.light.4.raw

SEQ ID NO: 537919 - DNA, 447 bp, Homo sapiens; identical to SEQ ID NO: 535201
  misc_feature: HIJSMM301BFZ3D.18.9.A09.1.454.light.4.raw

SEQ ID NO: 537920 - DNA, 498 bp, Homo sapiens; identical to SEQ ID NO: 537020
  misc_feature: HIJSMM301EI8TX.26.26.C04.1.454.light.4.raw

SEQ ID NO: 537921 - DNA, 498 bp, Homo sapiens
  misc_feature: HIJSMM301CHXEN.49.62.F07.1.454.light.4.raw
agtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattccctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 537922 - DNA, 462 bp, Homo sapiens
  misc_feature: HIJSMM301BYG7F.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaaagtggagatcaaacgaactgtggctgcaccatctgtcttcatcttcccgccatctgacactactatg

SEQ ID NO: 537923 - DNA, 441 bp, Homo sapiens
  misc_feature: HIJSMM301B35LH.11.3.A03.1.454.light.4.raw
cgagagataccacgaccggtgctcgatttagagagcgtcacagggtcctgggcccagtctgtgctgacgcagccgccctcagtgtctggggtcccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 537924 - DNA, 490 bp, Homo sapiens
  misc_feature: HIJSMM301B4QN4.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggccctgggacgtaaggttaggaggatacagacgaactgtggctgcaccatctgtcttcta

SEQ ID NO: 537925 - DNA, 496 bp, Homo sapiens
  misc_feature: HIJSMM301AY31I.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacc

SEQ ID NO: 537926 - DNA, 489 bp, Homo sapiens; identical to SEQ ID NO: 535091
  misc_feature: HIJSMM301D6IV6.47.36.D03.1.454.light.4.raw

SEQ ID NO: 537927 - DNA, 485 bp, Homo sapiens
  misc_feature: HIJSMM301DTGLL.49.42.D09.1.454.light.4.raw
agtcgagagacacgaccggtgctcgatttagacacatacgcaggaaaggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatct

SEQ ID NO: 537928 - DNA, 492 bp, Homo sapiens; identical to SEQ ID NO: 534967
  misc_feature: HIJSMM301EBO3J.47.64.F09.1.454.light.4.raw

SEQ ID NO: 537929 - DNA, 484 bp, Homo sapiens; identical to SEQ ID NO: 535211
  misc_feature: HIJSMM301C8M4Q.47.46.E02.1.454.light.4.raw

SEQ ID NO: 537930 - DNA, 518 bp, Homo sapiens
  misc_feature: HIJSMM301E1UXI.49.11.A11.1.454.light.4.raw
  modified_base (489)..(489): a, c, t, g, unknown or other
  modified_base (507)..(507): a, c, t, g, unknown or other
agtcgagagacacgaccggtgctcgatttagctacgactgcaggggctgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccacctgtnacctctcgttcccgcccncctctctctcg

SEQ ID NO: 537931 - DNA, 477 bp, Homo sapiens
  misc_feature: HIJSMM301B77MZ.48.5.A05.1.454.light.4.raw
agtatacatacacgaccggtgctcgatttagatagatagacagggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccaaggtggaaatcaaacgaactgtggctgcaccat

SEQ ID NO: 537932 - DNA, 519 bp, Homo sapiens
  misc_feature: HIJSMM301EW3D5.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgaacggaccgaacggtaggaaggtacgaaacgaacgtagtggcgtgcgaccactctgtcttctactcttcccgtcccact

SEQ ID NO: 537933 - DNA, 492 bp, Homo sapiens
  misc_feature: HIJSMM301CYSYC.48.71.G05.1.454.light.4.raw
agtatacatacacgaccggtgctcgatttagtgtcgtcgcaagagagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgttttctgtcagcagtatggaagttcacctcggacattcggccaggggaccaaggtggaaatcaaacgaactgtggctgcaccatctgtcttcatcttcccgccatctgatatgtatact

SEQ ID NO: 537934 - DNA, 513 bp, Homo sapiens
  misc_feature: HIJSMM301DSF23.12.28.C06.1.454.light.4.raw
atacgacgtacacgaccggtgctcgatttagagctcacgtattgggtttggggagtcagtctcagtcaggacacagcatggacatgagggtccccgcccagctcctggggctcctgctaatctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtccccccggacgtcgtccgacgggaccgaccgacgtagaaatagagacgaacgtagtggcgtgcaccactctgtcttctactcttcccgt

SEQ ID NO: 537935 - DNA, 501 bp, Homo sapiens
  misc_feature: HIJSMM301A0NSF.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttattactgccaacaatataatagtcattctcagacgttcggccaagggaccaaggtggaggtcaaacgaactgtggctgcaccatctgtcttcatcttcccg

SEQ ID NO: 537936 - DNA, 490 bp, Homo sapiens
  misc_feature: HIJSMM301ELIVD.48.87.H10.1.454.light.4.raw
agtatacatacacgaccggtgctcgatttagcagtactgcgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccc

SEQ ID NO: 537937 - DNA, 492 bp, Homo sapiens
  misc_feature: HIJSMM301AZXQS.14.55.E11.1.454.light.4.raw
  modified_base (452)..(452): a, c, t, g, unknown or other
  modified_base (456)..(456): a, c, t, g, unknown or other
  modified_base (482)..(482): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctacttcgtcggaggacgaacgaggngatncgagaactacgtggcgtgcaccactntcgtcttcta

SEQ ID NO: 537938 - DNA, 375 bp, Homo sapiens
  misc_feature: HIJSMM301ER5K1.9.11.A11.1.454.light.4.raw
tgatacgtctcacgaccggtgctcgatttagctacgactgcaggggagagagccaccctctcttgcaggaccagtctgcatattcccagcacctacgtagcctggtaccagcagaaacctggccagtctcccaggctcctcatctatggtgcgtccaccagggccactggcatcccagaccgcttcagttccagtgggtctgggacagacttcactctcaccatccgcggactggagcctgaagattttgcagtttattactgtcagcagtatggtagctcaccgtacacttttggccaggggaccaagctggagatcaaacgaactgtggctgcaccatctgtcttcatcttcccgccatctgaagacgtatca

SEQ ID NO: 537939 - DNA, 489 bp, Homo sapiens
  misc_feature: HIJSMM301C5WE3.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaattcggcggagggaccaaggtggagatcaaacgaactgtggctgcaccatctgtcttcatcttcccgcc

SEQ ID NO: 537940 - DNA, 508 bp, Homo sapiens
  misc_feature: HIJSMM301AZ9AT.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaagatgttggggtttattactgcatgcaaactacacacggccgctcactttcggcggagggaccgaaggtggaggatcaaacgaactagtggctgcaccatctgt

SEQ ID NO: 537941 - DNA, 416 bp, Homo sapiens
  misc_feature: HIJSMM301C110M.16.46.E02.1.454.light.4.raw
tgtactactccacgaccggtgctcgatttagactcatctacagggaaaggggctgtgcctggggtcgtcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccgccctcctcgagtagtaca

SEQ ID NO: 537942 - DNA, 447 bp, Homo sapiens; identical to SEQ ID NO: 535020
  misc_feature: HIJSMM301B4RK8.18.9.A09.1.454.light.4.raw

SEQ ID NO: 537943 - DNA, 497 bp, Homo sapiens
  misc_feature: HIJSMM301C9CRF.21.15.B04.1.454.light.4.raw
tcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatcctcctccgacaataagaactacttagcttggtaccagcagcaaccaggacaacgtcctaaattgctcatttactgggcatctgtccgggaatccggggtccctgaccgattcgttggcagcgggtctgggacagatttcactctcaccatcagcagcctacaggctgaagatgtggcagtttattttgtatgcaacattatgccgctccgctcactttcggcggagggaccaaggtggagatcaaacgaactgtggctgcaccat

SEQ ID NO: 537944 - DNA, 494 bp, Homo sapiens; identical to SEQ ID NO: 534994
  misc_feature: HIJSMM301ANNYC.27.78.H01.1.454.light.4.raw

SEQ ID NO: 537945 - DNA, 488 bp, Homo sapiens
  misc_feature: HIJSMM301EAQFG.26.55.E11.1.454.light.4.raw
agactatactcacgaccggtgctcgatttagcactcgcacgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactgtggctgcacca

SEQ ID NO: 537946 - DNA, 482 bp, Homo sapiens
  misc_feature: HIJSMM301AZUTJ.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgctagtttattactgtcagcactataataactggcctccgtactagttttggtcaggggaccaagctggagatcaaacgaa

SEQ ID NO: 537947 - DNA, 473 bp, Homo sapiens
  misc_feature: HIJSMM301CX9FN.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttactttgtcaacaggctcagagtttcccgctcactttcggcggagggaccaaggtggaggatcaaacgactgtgg

SEQ ID NO: 537948 - DNA, 485 bp, Homo sapiens; identical to SEQ ID NO: 535606
  misc_feature: HIJSMM301ES3RA.47.46.E02.1.454.light.4.raw

SEQ ID NO: 537949 - DNA, 481 bp, Homo sapiens
  misc_feature: HIJSMM301A3A2N.41.44.D11.1.454.light.4.raw
tctatactatcacgaccggtgctcgatttagcgcagtacgaatggggcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaagatgtttcggccaatgcaggcattttagtcatctctggggtccagtttgtggatgaggctgactactattgcacggtctggtacagcagcgctgtggtcttcggcggagggactgaacttatcgtcctaggtcagccc

SEQ ID NO: 537950 - DNA, 506 bp, Homo sapiens; identical to SEQ ID NO: 534969
  misc_feature: HIJSMM301EPKSC.18.37.D04.1.454.light.4.raw

SEQ ID NO: 537951 - DNA, 490 bp, Homo sapiens
  misc_feature: HIJSMM301AXLVM.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttccccctcactttcggcggagggaccaaggtggagatcaagcgaactgtggctgcaccatctgtctt

SEQ ID NO: 537952 - DNA, 489 bp, Homo sapiens
  misc_feature: HIJSMM301CCF5H.4.27.C05.1.454.light.4.raw
agcactgtagcacgaccggtgctcgatttagacgcgatcgaagggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggccaggggaccaggctggagatcaaacgaactgtggc

SEQ ID NO: 537953 - DNA, 494 bp, Homo sapiens; identical to SEQ ID NO: 534994
  misc_feature: HIJSMM301BDJ54.27.78.H01.1.454.light.4.raw

SEQ ID NO: 537954 - DNA, 508 bp, Homo sapiens
  misc_feature: HIJSMM301BFEI4.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactctgttccca

SEQ ID NO: 537955 - DNA, 492 bp, Homo sapiens
  misc_feature: HIJSMM301AI2RK.15.67.G01.1.454.light.4.raw
tctacgtagccacgaccggtgctcgatttagagtatacatattgggtttggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccagggaccgaacggtaggaaagtacaacgaactagtggcgtgcacca

SEQ ID NO: 537956 - DNA, 490 bp, Homo sapiens
  misc_feature: HIJSMM301AQWD6.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgtgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatagactttgcaacttattactgccaacagtataatggttatgaatccacttttggccaagggaccaagctggagatcaaacgaactgtggctgcacca

SEQ ID NO: 537957 - DNA, 484 bp, Homo sapiens; identical to SEQ ID NO: 536395
  misc_feature: HIJSMM301BPGVL.46.35.D02.1.454.light.4.raw

SEQ ID NO: 537958 - DNA, 501 bp, Homo sapiens
  misc_feature: HIJSMM301AISIR.17.27.C05.1.454.light.4.raw
cgtagactagcacgaccggtgctcgatttagacgcgatcgaagggtttgggagctgtgggctcagaagcagagttctggggtgtctccaccatggcctggacccctctctggctcactctcctcactctttgtcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctgccccctcggtca

SEQ ID NO: 537959 - DNA, 485 bp, Homo sapiens
  misc_feature: HIJSMM301CBX4C.12.88.H11.1.454.light.4.raw
atacgacgtacacgaccggtgctcgatttagcgacagcgagaacacacaaagggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccggtggggctgaggatgttggcattattactgcatgcaggctatacaccttcctgccacttttggccagggaccaagctggaggatcaggcgtaacg

SEQ ID NO: 537960 - DNA, 465 bp, Homo sapiens
  misc_feature: HIJSMM301CDZ8I.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaaccacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccaccctcctccatactcgta

SEQ ID NO: 537961 - DNA, 502 bp, Homo sapiens; identical to SEQ ID NO: 537339
  misc_feature: HIJSMM301AK0MX.19.85.H08.1.454.light.4.raw

SEQ ID NO: 537962 - DNA, 472 bp, Homo sapiens
  misc_feature: HIJSMM301DSTQE.40.1.A01.1.454.light.4.raw
tctagcgactcacgaccggtgctcgatttagacgtctcatcagggggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaccagggaaagcccctaagctcctgatctacgatgcatctaagttggaacaggggtctcatcaaggttcagtggaagtggatctgggacagatcctactttcaccatcagcagcctgcagccagaagatattgcgacatatttctgtcaggtgtatgaaagtctccctgttttggtccaggggaccaaggtggagatcaaacgaactgtggctgcaccat

SEQ ID NO: 537963 - DNA, 469 bp, Homo sapiens
  misc_feature: HIJSMM301BNN5R.51.11.A11.1.454.light.4.raw
cgatcgtatacacgaccggtgctcgatttagctacgactgcaggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcac

SEQ ID NO: 537964 - DNA, 447 bp, Homo sapiens; identical to SEQ ID NO: 535201
  misc_feature: HIJSMM301AM6IF.18.9.A09.1.454.light.4.raw

SEQ ID NO: 537965 - DNA, 464 bp, Homo sapiens; identical to SEQ ID NO: 536640
  misc_feature: HIJSMM301BX6G6.26.78.H01.1.454.light.4.raw

SEQ ID NO: 537966 - DNA, 484 bp, Homo sapiens; identical to SEQ ID NO: 535240
  misc_feature: HIJSMM301DZ6Y6.47.60.F05.1.454.light.4.raw

SEQ ID NO: 537967 - DNA, 493 bp, Homo sapiens; identical to SEQ ID NO: 536471
  misc_feature: HIJSMM301ETVFO.3.71.G05.1.454.light.4.raw

SEQ ID NO: 537968 - DNA, 471 bp, Homo sapiens
  misc_feature: HIJSMM301B4SPU.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccataccccaatcacttcgcctggactgaagtgcatatgaagagaactgtggctgca

SEQ ID NO: 537969 - DNA, 507 bp, Homo sapiens
  misc_feature: HIJSMM301AYVI8.9.53.E09.1.454.light.4.raw
tgatacgtctcacgaccggtgctcgatttagagagagtgtgttgggtttgggggggtcgacaagaggcagcgctctcgggacgtctccaccatggcctgggctctgctgctcctcaccctcctcactcaggacacagggtccgtgggcccagtctgccctgactcagcctgcctccgtgtctgggtctcctggacagtcgatcaccatctcctgcactggacccaccactgatatttgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcc

SEQ ID NO: 537970 - DNA, 503 bp, Homo sapiens
  misc_feature: HIJSMM301AJZ5C.10.39.D06.1.454.light.4.raw
catagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgaggccggggatgaggccgactactactgtcaggtgtgggatttcactactgatcatgtgggggtcttcggcggagggaccaagctgaccgtcctaagtcagcccaaggctgccccctcggtca

SEQ ID NO: 537971 - DNA, 444 bp, Homo sapiens
  misc_feature: HIJSMM301AW2A8.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctctgtcgagcgt

SEQ ID NO: 537972 - DNA, 472 bp, Homo sapiens; identical to SEQ ID NO: 536302
  misc_feature: HIJSMM301A6JNE.18.76.G10.1.454.light.4.raw

SEQ ID NO: 537973 - DNA, 515 bp, Homo sapiens
  misc_feature: HIJSMM301B7FP2.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcct

SEQ ID NO: 537974 - DNA, 491 bp, Homo sapiens
  misc_feature: HIJSMM301DAG1I.49.56.F01.1.454.light.4.raw
  modified_base (434)..(434): a, c, t, g, unknown or other
agtcgagagacacgaccggtgctcgatttagcagacgtctgaacacacaaagggggagtcagtctcagtcaggacccagcatggacatgagggtccccgctcagctcctggggctcctgctactctggctccgaggtgccagatgtgacatccagatgacccagtctccatcttccctgtctgcatctctgggagacagagtcaccatcacttgccaggcgagtcagaccattggctaactttttaaattggtatcaacacaaaccagggaaagcccctaaactcctgatctatgctgcatccactttgcaaagtggggtcccttcaaggttcagtgccagtggatctgggacagacttcaccctcaccatcgacagtctgcaacctgaagatttgcaacttacttctgtcaacagagtttcgcttccccctanacttttggtcaggggaccaagctggcgatcaaacgactgtggctgcaccatctgtct

SEQ ID NO: 537975 - DNA, 463 bp, Homo sapiens; identical to SEQ ID NO: 535062
  misc_feature: HIJSMM301DKTYX.11.73.G07.1.454.light.4.raw

SEQ ID NO: 537976 - DNA, 501 bp, Homo sapiens
  misc_feature: HIJSMM301EC962.51.19.B08.1.454.light.4.raw
cgatcgtatacacgaccggtgctcgatttagtgagtcagtaagggggggtcgacaagaggcagcgctctcgggacggtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcattatttatgaggccagtaggcgagcctcagggatttctagtcgcttctctgcctccgcgtctggcaacacggcctccctgacaatttctgggctccagcctgaggacgagtctcactactactgctcctcatatgcagacaatagtttcctggtgttcggcggaggaccaagttgccgtcctaggtcacgccaaggctcgccccctcggtcact

SEQ ID NO: 537977 - DNA, 502 bp, Homo sapiens
  misc_feature: HIJSMM301D64LD.48.68.G02.1.454.light.4.raw
agtatacatacacgaccggtgctcgatttagtcgatagtgaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccgcccta

SEQ ID NO: 537978 - DNA, 490 bp, Homo sapiens
  misc_feature: HIJSMM301B6YVV.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcaattttggccaggggaccaaactggatatcagacgaactgtggctgca

SEQ ID NO: 537979 - DNA, 508 bp, Homo sapiens
  misc_feature: HIJSMM301A0O33.48.30.C08.1.454.light.4.raw
agtatacatacacgaccggtgctcgatttagtctgacgtcaaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttttacgtcgggaccttcggtccgaacgggacgacgacctggaggattaaacgaactagtggctgcaccactctgtcttcatcttcccg

SEQ ID NO: 537980 - DNA, 512 bp, Homo sapiens
  misc_feature: HIJSMM301C1ETT.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggtccaacgggaccaaggtaggaaatacgaaacgaactagtggctgcaccatctcgtcttctatcttccccg

SEQ ID NO: 537981 - DNA, 488 bp, Homo sapiens
  misc_feature: HIJSMM301ESOIZ.19.71.G05.1.454.light.4.raw
tactctcgtgcacgaccggtgctcgatttagtgtcgtcgcaagagagaggggggaggtacaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaacgggaccgaagtaggatatcagagaa

SEQ ID NO: 537982 - DNA, 464 bp, Homo sapiens
  misc_feature: HIJSMM301BMFGG.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccgccctcctcctagtctacg

SEQ ID NO: 537983 - DNA, 486 bp, Homo sapiens; identical to SEQ ID NO: 537617
  misc_feature: HIJSMM301BTKQQ.10.53.E09.1.454.light.4.raw

SEQ ID NO: 537984 - DNA, 510 bp, Homo sapiens
  misc_feature: HIJSMM301DIR28.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcaggacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctcgtcctacgtcagcccaaggccaacccactcgtcactctgttcccta

SEQ ID NO: 537985 - DNA, 511 bp, Homo sapiens
  misc_feature: HIJSMM301A2KQA.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgactactcctaccggtccgaacggaacggaccacgacgtaggaattaaacgtaaacagttggcgtcgcaccactctcgtcttctact

SEQ ID NO: 537986 - DNA, 447 bp, Homo sapiens; identical to SEQ ID NO: 535201
  misc_feature: HIJSMM301BQ73C.18.9.A09.1.454.light.4.raw

SEQ ID NO: 537987 - DNA, 495 bp, Homo sapiens; identical to SEQ ID NO: 535596
  misc_feature: HIJSMM301ASEC1.10.79.H02.1.454.light.4.raw

SEQ ID NO: 537988 - DNA, 508 bp, Homo sapiens
  misc_feature: HIJSMM301C4930.17.33.C11.1.454.light.4.raw
cgtagactagcacgaccggtgctcgatttagagtgagctcgttgggtttgggggcgccaggggtcccttccaatatcagcaccatggcctggactcctctctttctgttcatcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtctaagtcagcccaaggctgccccctcggtcactctgttcccaccct

SEQ ID NO: 537989 - DNA, 472 bp, Homo sapiens
  misc_feature: HIJSMM301CBIKR.49.4.A04.1.454.light.4.raw
agtcgagagacacgaccggtgctcgatttagagtagtgatcaggggagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatagtctcccgctcactttcgcgggggaccgaaggtggagatcaagcgaacgtgtggctgcaccta

SEQ ID NO: 537990 - DNA, 497 bp, Homo sapiens; identical to SEQ ID NO: 535740
  misc_feature: HIJSMM301BRUFZ.3.71.G05.1.454.light.4.raw

SEQ ID NO: 537991 - DNA, 444 bp, Homo sapiens; identical to SEQ ID NO: 534993
  misc_feature: HIJSMM301D6XE9.5.9.A09.1.454.light.4.raw

SEQ ID NO: 537992 - DNA, 487 bp, Homo sapiens; identical to SEQ ID NO: 536272
  misc_feature: HIJSMM301CSHG2.17.25.C03.1.454.light.4.raw

SEQ ID NO: 537993 - DNA, 487 bp, Homo sapiens; identical to SEQ ID NO: 537009
  misc_feature: HIJSMM301C1TQ1.12.88.H11.1.454.light.4.raw

SEQ ID NO: 537994 - DNA, 483 bp, Homo sapiens
  misc_feature: HIJSMM301CIAGV.26.60.F05.1.454.light.4.raw
agactatactcacgaccggtgctcgatttagtacgtcatcagggaaaggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 537995 - DNA, 518 bp, Homo sapiens
  misc_feature: HIJSMM301ATIXI.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccgccctcctccgtgt

SEQ ID NO: 537996 - DNA, 484 bp, Homo sapiens
  misc_feature: HIJSMM301DXPWH.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgcagtttattcctgtcagcagtacaatgactggccgtacacttttggccaggggaccaagctggagatcaacgaactgtggctgcacc

SEQ ID NO: 537997 - DNA, 497 bp, Homo sapiens
  misc_feature: HIJSMM301C36OH.51.23.C01.1.454.light.4.raw
cgatcgtatacacgaccggtgctcgatttagtacacgtgattagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattatgtcaatcaacagacaccattggtacttatgtcttcggaactgcgaccaaggtcaccgtcctggggtcagccccaaggccaaccccactgtcact

SEQ ID NO: 537998 - DNA, 504 bp, Homo sapiens
  misc_feature: HIJSMM301AT6DJ.10.33.C11.1.454.light.4.raw
  modified_base (497)..(497): a, c, t, g, unknown or other
catagtagtgcacgaccggtgctcgatttagagtgagctcgttgggtttggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcggggggacgaacggtaggagttactaaacgaactagtggtcgtgcaccactctcgtnttcctat

SEQ ID NO: 537999 - DNA, 447 bp, Homo sapiens; identical to SEQ ID NO: 535882
  misc_feature: HIJSMM301EHTM0.18.9.A09.1.454.light.4.raw
  modified_base (429)..(429): a, c, t, g, unknown or other

SEQ ID NO: 538000 - DNA, 487 bp, Homo sapiens; identical to SEQ ID NO: 536206
  misc_feature: HIJSMM301ADKX0.47.38.D05.1.454.light.4.raw

SEQ ID NO: 538001 - DNA, 444 bp, Homo sapiens; identical to SEQ ID NO: 535042
  misc_feature: HIJSMM301A3J0N.10.76.G10.1.454.light.4.raw

SEQ ID NO: 538002 - DNA, 494 bp, Homo sapiens; identical to SEQ ID NO: 535090
  misc_feature: HIJSMM301CG3TB.27.78.H01.1.454.light.4.raw
  modified_base (403)..(403): a, c, t, g, unknown or other

SEQ ID NO: 538003 - DNA, 495 bp, Homo sapiens; identical to SEQ ID NO: 535596
  misc_feature: HIJSMM301BXEBQ.10.79.H02.1.454.light.4.raw

SEQ ID NO: 538004 - DNA, 491 bp, Homo sapiens
  misc_feature: HIJSMM301C4UC3.5.57.F02.1.454.light.4.raw
atcagacacgcacgaccggtgctcgatttagctcgatatagttgggtttgggggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtcttca

SEQ ID NO: 538005 - DNA, 485 bp, Homo sapiens
  misc_feature: HIJSMM301AWY79.48.9.A09.1.454.light.4.raw
agtatacatacacgaccggtgctcgatttagcgagacgcgcaggggagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggaccgagggtggaatacaacgaactagtggctgcaccatctgtcttctat

SEQ ID NO: 538006 - DNA, 501 bp, Homo sapiens
  misc_feature: HIJSMM301CNCGG.47.66.F11.1.454.light.4.raw
agctcacgtacacgaccggtgctcgatttagtcacgcgagaagggggaggaactgctcagttaggacccagagggaaccatggaagccccacgctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttattactgtcagcagcgtaacaattggccgatcaccttcggccaagggacacgactggagattaaacgaactgtggctgcaccatctgtcttcatcttcccgccat

SEQ ID NO: 538007 - DNA, 519 bp, Homo sapiens
  misc_feature: HIJSMM301ES5MW.41.55.E11.1.454.light.4.raw
tctatactatcacgaccggtgctcgatttagcactcgcacgttgggtttgggggggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccaccctcctc

SEQ ID NO: 538008 - DNA, 494 bp, Homo sapiens; identical to SEQ ID NO: 535184
  misc_feature: HIJSMM301CPSTN.16.71.G05.1.454.light.4.raw

SEQ ID NO: 538009 - DNA, 494 bp, Homo sapiens
  misc_feature: HIJSMM301B5COM.51.27.C05.1.454.light.4.raw
cgatcgtatacacgaccggtgctcgatttagacgcgatcgaagggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtggttcggcgggggaccaagctgaccgtcctcggtcagcccaaggctcgccccctcggtcta

SEQ ID NO: 538010 - DNA, 506 bp, Homo sapiens
  misc_feature: HIJSMM301DVZTZ.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccttggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcc

SEQ ID NO: 538011 - DNA, 492 bp, Homo sapiens
  misc_feature: HIJSMM301AW43S.14.53.E09.1.454.light.4.raw
cgtctagtaccacgaccggtgctcgatttagagagagtgtgttggggtttggggggggaggcctagctgtgctgtgggtccgaggaggcagaactctgggtggtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctcctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtccta

SEQ ID NO: 538012 - DNA, 489 bp, Homo sapiens
  misc_feature: HIJSMM301AM12W.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccgaaggtggaagtcaagcgaactgtggctgcaccatctgt

SEQ ID NO: 538013 - DNA, 504 bp, Homo sapiens
  misc_feature: HIJSMM301D47SL.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatcaaacgaactagtggctgcaccatctgtcttcatcttccccg

SEQ ID NO: 538014 - DNA, 503 bp, Homo sapiens
  misc_feature: HIJSMM301CRH25.48.36.D03.1.454.light.4.raw
agtatacatacacgaccggtgctcgatttagctgcgtcacgagctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaacccactgtcta

SEQ ID NO: 538015 - DNA, 476 bp, Homo sapiens
  misc_feature: HIJSMM301DVQBF.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagattttgttaaggggaaagtaatgaagttaacactgtggatcaccttcggccaagggacacgactggagattaaacgaactgtggctgcaccatctgtcttcatcttcccgccatctgaagtatagtct

SEQ ID NO: 538016 - DNA, 489 bp, Homo sapiens
  misc_feature: HIJSMM301EPS1H.46.35.D02.1.454.light.4.raw
actagcagtacacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgtcagtctattactgtcagcagtatggtcacgtcccaagaaacttttggtccagggaccgaagactggaggatcaaacgaaactgtggctgcacca

SEQ ID NO: 538017 - DNA, 488 bp, Homo sapiens
  misc_feature: HIJSMM301CHDNC.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggcgtgggacagcagcactgaggtgttcggcggagggaccaagctgaccgtcctacgtcagcccaaggctgccccctc

SEQ ID NO: 538018 - DNA, 494 bp, Homo sapiens; identical to SEQ ID NO: 534992
  misc_feature: HIJSMM301A9SP5.9.1.A01.1.454.light.4.raw

SEQ ID NO: 538019 - DNA, 483 bp, Homo sapiens
  misc_feature: HIJSMM301EIT1C.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaaactgtggctgcaccat

SEQ ID NO: 538020 - DNA, 474 bp, Homo sapiens
  misc_feature: HIJSMM301EAYCH.49.75.G09.1.454.light.4.raw
agtcgagagacacgaccggtgctcgatttagtatagacatcaggggggtccctcgctcagctcctggggcgtcctgctgctctggctctcaagtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggaccgaacggtggaggatccagcgaactgtggctgcaccatctgtcttcatcttcccgccatctgatct

SEQ ID NO: 538021 - DNA, 491 bp, Homo sapiens
  misc_feature: HIJSMM301BJFMD.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccaaggtggagatcaaacgaactgtggctgcaccatctgtt

SEQ ID NO: 538022 - DNA, 486 bp, Homo sapiens; identical to SEQ ID NO: 535043
  misc_feature: HIJSMM301C4LCZ.46.35.D02.1.454.light.4.raw

SEQ ID NO: 538023 - DNA, 515 bp, Homo sapiens
  misc_feature: HIJSMM301BL53C.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcgagggaccaagctgaccgtctaggtcagcccaaggctgccccctggtcactctgttcccaccctcctcacg

SEQ ID NO: 538024 - DNA, 505 bp, Homo sapiens
  misc_feature: HIJSMM301AXQAU.52.36.D03.1.454.light.4.raw
  modified_base (470)..(470): a, c, t, g, unknown or other
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgaccgtcctacgtcancccaaggctgccccctcggtcactctgttcccccg

SEQ ID NO: 538025 - DNA, 499 bp, Homo sapiens
  misc_feature: HIJSMM301B75UQ.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatacaacgaactgtggctgcacca

SEQ ID NO: 538026 - DNA, 476 bp, Homo sapiens
  misc_feature: HIJSMM301BY5H6.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagaccccg

SEQ ID NO: 538027 - DNA, 488 bp, Homo sapiens; identical to SEQ ID NO: 537124
  misc_feature: HIJSMM301BJNGH.11.25.C03.1.454.light.4.raw

SEQ ID NO: 538028 - DNA, 498 bp, Homo sapiens
  misc_feature: HIJSMM301BA45K.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttactgtcagcagtatagtaactggcctccgtacacttttggtccacggggaccgaagctagaaatacaaacgaaactgtggctgcaccatctgtcttcta

SEQ ID NO: 538029 - DNA, 494 bp, Homo sapiens; identical to SEQ ID NO: 534992
  misc_feature: HIJSMM301AODKG.9.1.A01.1.454.light.4.raw

SEQ ID NO: 538030 - DNA, 497 bp, Homo sapiens
  misc_feature: HIJSMM301EOBOE.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcatt

SEQ ID NO: 538031 - DNA, 502 bp, Homo sapiens; identical to SEQ ID NO: 537363
  misc_feature: HIJSMM301DPG92.18.23.C01.1.454.light.4.raw

SEQ ID NO: 538032 - DNA, 495 bp, Homo sapiens
  misc_feature: HIJSMM301A8Q6Q.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtcctaacaggttcagtggcagtggatcaggcacagattttacactgaaaatcagcagagtggaggctgaggatgttggggtttattactgcatgcaagctctacaacctctgcggactttcggccctgggaccaaagtaggagatcaaacgaaactgtggctgcaccatctgtctt

SEQ ID NO: 538033 - DNA, 441 bp, Homo sapiens; identical to SEQ ID NO: 534971
  misc_feature: HIJSMM301ANK4S.11.3.A03.1.454.light.4.raw

SEQ ID NO: 538034 - DNA, 483 bp, Homo sapiens
  misc_feature: HIJSMM301EJIO6.46.35.D02.1.454.light.4.raw
actagcagtacacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaactttggccagggaccaagctggagatcaaacgaactgtggctgcaccat

SEQ ID NO: 538035 - DNA, 504 bp, Homo sapiens
  misc_feature: HIJSMM301DZKNM.5.68.G02.1.454.light.4.raw
  modified_base (492)..(492): a, c, t, g, unknown or other
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagatttttataagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcagcccaaggctgccccctcggtcactctgttcccncctcctccgtgt

SEQ ID NO: 538036 - DNA, 507 bp, Homo sapiens
  misc_feature: HIJSMM301CEOFZ.48.14.B03.1.454.light.4.raw
agtatacatacacgaccggtgctcgatttagtgtgagtagttccgcggggactgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaaggacccgggtggaataaacgaactgtggctgcaccatctgtcttcta

SEQ ID NO: 538037 - DNA, 448 bp, Homo sapiens; identical to SEQ ID NO: 536712
  misc_feature: HIJSMM301DWIPJ.18.9.A09.1.454.light.4.raw

SEQ ID NO: 538038 - DNA, 512 bp, Homo sapiens
  misc_feature: HIJSMM301AKM9Y.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactttgttcccgccctcct

SEQ ID NO: 538039 - DNA, 486 bp, Homo sapiens
  misc_feature: HIJSMM301B10I2.26.37.D04.1.454.light.4.raw
agactatactcacgaccggtgctcgatttagtagcatactgttgggtttggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactgtggctgcacc

SEQ ID NO: 538040 - DNA, 496 bp, Homo sapiens; identical to SEQ ID NO: 536802
  misc_feature: HIJSMM301A92US.5.24.C02.1.454.light.4.raw

SEQ ID NO: 538041 - DNA, 468 bp, Homo sapiens
  misc_feature: HIJSMM301CMOIF.40.2.A02.1.454.light.4.raw
tctagcgactcacgaccggtgctcgatttagactcatctacagggggcaggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaagcccctcagctcctgatctatactgcatccactttacaaagtggagtcccatcaaggttcagcggcagtggatctggcacagatttcactctcaccatcagcagcctgcagcctgaagattttgcaacttattactgtctacaagattacaattaccctcggacttttggccaggggacctggctggagatcaaacgaact

SEQ ID NO: 538042 - DNA, 481 bp, Homo sapiens
  misc_feature: HIJSMM301C6L93.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcagggtccctgaccgattctctggctccaagtctggcacctcagcctccctggtcatcgctgggctccaggctgacgatgaggctgattattattgccagtcctatgacaacacctcgcgtggttttggtctgttcggcggcgggacc

SEQ ID NO: 538043 - DNA, 502 bp, Homo sapiens
  misc_feature: HIJSMM301BERNO.51.5.A05.1.454.light.4.raw
cgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcgagggggtcttcggcggagggacgagctgaccgtcctgagtcacgcccaaggctcgcccccgtcggtacacttcg

SEQ ID NO: 538044 - DNA, 496 bp, Homo sapiens; identical to SEQ ID NO: 535109
  misc_feature: HIJSMM301AKCHA.16.78.H01.1.454.light.4.raw

SEQ ID NO: 538045 - DNA, 488 bp, Homo sapiens
  misc_feature: HIJSMM301C3O05.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctacctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccatctgt

SEQ ID NO: 538046 - DNA, 520 bp, Homo sapiens
  misc_feature: HIJSMM301DDAM6.49.26.C04.1.454.light.4.raw
agtcgagagacacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaaatcacagaggaatattcggcggagggaccaagctgaccgtcctaggtcagcccaaggctgccccctcggtcactctgttcccaccctcctct

SEQ ID NO: 538047 - DNA, 506 bp, Homo sapiens
  misc_feature: HIJSMM301A8DK8.15.86.H09.1.454.light.4.raw
tctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaaggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcacg

SEQ ID NO: 538048 - DNA, 500 bp, Homo sapiens
  misc_feature: HIJSMM301B34Q3.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcgggagggaccgaacgctgaccgtcctgggtcgagcccaacggctgccccctccggtcact

SEQ ID NO: 538049 - DNA, 493 bp, Homo sapiens
  misc_feature: HIJSMM301BCNO4.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgtagcctgaagattttgcaacttattactgtcaacagtttaataactaccctctcactttcggaggagggaccagggtggagatcaaacgaactgtggctgcaccatctgtcttcat

SEQ ID NO: 538050 - DNA, 485 bp, Homo sapiens
  misc_feature: HIJSMM301AOOM3.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttcccttaatcttcggccaagggacacgactggagattaaacgaactagtggctgcacca

SEQ ID NO: 538051 - DNA, 494 bp, Homo sapiens; identical to SEQ ID NO: 534992
  misc_feature: HIJSMM301EJXQ3.9.1.A01.1.454.light.4.raw

SEQ ID NO: 538052 - DNA, 501 bp, Homo sapiens
  misc_feature: HIJSMM301BFHDG.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggccgggaccaagtggaatcaaacgaactgtggctgcaccatctgtcttcatctccgcc

SEQ ID NO: 538053 - DNA, 485 bp, Homo sapiens
  misc_feature: HIJSMM301BM3T8.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaa

SEQ ID NO: 538054 - DNA, 505 bp, Homo sapiens
  misc_feature: HIJSMM301B1RO4.8.55.E11.1.454.light.4.raw
ctcgcgtgtccacgaccggtgctcgatttagcactcgcacgttgggtttggggagctctgcttcagctgtgagcgcagaaggcaggactcgggacaatcgtcatcatgacctgctcccctctcctcctcacccttctcattcactgcacagggtcctgggcccagcctgtgttgacgcaggcgccctcagtatctgcggccccgggacagagggtcaccatctcctgctccggaagcacctcaaatattggggacagttttgtatcgtggtatcagcaagtccccggaacagcccccaaactcctcatttatgaggataatgagcgacgttcaggaattcctgaccgtttctctggctccaagtctggcacgtcagccaccctgggcatcaccggactccagactggggacgaggccgactattactgcggagcatgggatagcagcctgaacactgtggtcttcggcggagggaccaagctgaccgtccttagtcagcccaagg

SEQ ID NO: 538055 - DNA, 498 bp, Homo sapiens
  misc_feature: HIJSMM301A0T8D.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagattttcactctcaccatcagcagcctgcaggctgaagatgtggcagtttattattgtcagcaatattatattcctcctcagacgttcggccaagggaccaaggtggaaatcaaacgaactgtggctgcacca

SEQ ID NO: 538056 - DNA, 498 bp, Homo sapiens
  misc_feature: HIJSMM301AHIKH.15.25.C03.1.454.light.4.raw
tctacgtagccacgaccggtgctcgatttagtagtgtagatttgggtttgggggatcaggactcctcatttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactgtggctgcaccat

SEQ ID NO: 538057 - DNA, 508 bp, Homo sapiens
  misc_feature: HIJSMM301BFK6Y.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaagtacaaacgaactagtggctgcaccatctgtcttctatcttccccg

SEQ ID NO: 538058 - DNA, 486 bp, Homo sapiens; identical to SEQ ID NO: 535290
  misc_feature: HIJSMM301EI632.3.12.B01.1.454.light.4.raw

SEQ ID NO: 538059 - DNA, 486 bp, Homo sapiens; identical to SEQ ID NO: 535043
  misc_feature: HIJSMM301C86D5.46.35.D02.1.454.light.4.raw

SEQ ID NO: 538060 - DNA, 473 bp, Homo sapiens
  misc_feature: HIJSMM301AIUMO.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccgaaggtggacatcaaacgaa

SEQ ID NO: 538061 - DNA, 497 bp, Homo sapiens
  misc_feature: HIJSMM301BT4MF.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccaccctcctcgagtagtaca

SEQ ID NO: 538062 - DNA, 447 bp, Homo sapiens; identical to SEQ ID NO: 535201
  misc_feature: HIJSMM301DVBBA.18.9.A09.1.454.light.4.raw

SEQ ID NO: 538063 - DNA, 507 bp, Homo sapiens
  misc_feature: HIJSMM301AUPQ2.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcact

SEQ ID NO: 538064 - DNA, 513 bp, Homo sapiens; identical to SEQ ID NO: 535244
  misc_feature: HIJSMM301C3PQC.17.33.C11.1.454.light.4.raw

SEQ ID NO: 538065 - DNA, 485 bp, Homo sapiens; identical to SEQ ID NO: 536040
  misc_feature: HIJSMM301BJVBD.15.1.A01.1.454.light.4.raw

SEQ ID NO: 538066 - DNA, 476 bp, Homo sapiens
  misc_feature: HIJSMM301DQAQ0.49.45.E01.1.454.light.4.raw
agtcgagagacacgaccggtgctcgatttagtgagtcagtaagggaaagggcacagcatggacatgagggtccccgctcagctcctggggctcctgctactctggctccgaggtgccagatgtgacatccagatgacccagtctccatcctccctgtctgcatctgtaggagacagagtcaccatcatttgccgggccactgagaacattaatcgctggttggcctggtatcagcagaaaccagggaaagcccctgaggccctcatctatctggcgtctagtttagagagtggggtcccatcaagattcagcggcaatggatctgggacagaattcactctcaccattagcagcctgcagcctgatgatcttgcaacttattactgccaacattataatagttatatgtacatttttggccaggggaccaaagttggagatcaaacgaaactgtggctgcaccatctgtcttcatt

SEQ ID NO: 538067 - DNA, 454 bp, Homo sapiens; identical to SEQ ID NO: 536943
  misc_feature: HIJSMM301EL16S.19.86.H09.1.454.light.4.raw

SEQ ID NO: 538068 - DNA, 509 bp, Homo sapiens
  misc_feature: HIJSMM301ANZ24.52.72.G06.1.454.light.4.raw
cgcagtacgacacgaccggtgctcgatttagctacgactgcaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtca

SEQ ID NO: 538069 - DNA, 446 bp, Homo sapiens; identical to SEQ ID NO: 536034
  misc_feature: HIJSMM301BX4AL.18.9.A09.1.454.light.4.raw

SEQ ID NO: 538070 - DNA, 497 bp, Homo sapiens; identical to SEQ ID NO: 534982
  misc_feature: HIJSMM301DUHAL.26.80.H03.1.454.light.4.raw

SEQ ID NO: 538071 - DNA, 505 bp, Homo sapiens; identical to SEQ ID NO: 535987
  misc_feature: HIJSMM301B7S8R.18.37.D04.1.454.light.4.raw

SEQ ID NO: 538072 - DNA, 496 bp, Homo sapiens
  misc_feature: HIJSMM301BRE62.3.35.D02.1.454.light.4.raw
agacgcactccacgaccggtgctcgatttagcacacgatagttgggtttggggactgatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaagctacacactggccgtacacttttggccagggaccaagctggagatcaaacgaactgtggctgca

SEQ ID NO: 538073 - DNA, 464 bp, Homo sapiens
  misc_feature: HIJSMM301A6MM8.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgtcagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagatagcgctgccccgctcagtttcggcggagggaccaaggtggagatac

SEQ ID NO: 538074 - DNA, 489 bp, Homo sapiens
  misc_feature: HIJSMM301DJKAV.5.23.C01.1.454.light.4.raw
atcagacacgcacgaccggtgctcgatttagtacacgtgattagggattggggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaaactgtggctgcaccat

SEQ ID NO: 538075 - DNA, 444 bp, Homo sapiens; identical to SEQ ID NO: 535411
  misc_feature: HIJSMM301DN64C.8.73.G07.1.454.light.4.raw

SEQ ID NO: 538076 - DNA, 483 bp, Homo sapiens
  misc_feature: HIJSMM301DBY3F.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtctaggtcagcccaaggctgccccctcggtca

SEQ ID NO: 538077 - DNA, 507 bp, Homo sapiens; identical to SEQ ID NO: 535641
  misc_feature: HIJSMM301DW890.10.88.H11.1.454.light.4.raw

SEQ ID NO: 538078 - DNA, 454 bp, Homo sapiens
  misc_feature: HIJSMM301D4C12.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtccctaagtcagcgcaaggctgccccctcggtcactctgttcccgccctcctccacgagagta

SEQ ID NO: 538079 - DNA, 486 bp, Homo sapiens; identical to SEQ ID NO: 535043
  misc_feature: HIJSMM301CVYBN.46.35.D02.1.454.light.4.raw

SEQ ID NO: 538080 - DNA, 495 bp, Homo sapiens
  misc_feature: HIJSMM301CW02E.27.78.H01.1.454.light.4.raw
agcgtcgtctcacgaccggtgctcgatttagtgtgagtagtttgggtttggggatgagcaaaactagacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtacttacttacctcaagtgatcaccttcggccaagggacacgactggagattaaacgaactgtggctgcaccatctgtctt

SEQ ID NO: 538081 - DNA, 498 bp, Homo sapiens
  misc_feature: HIJSMM301DQF11.10.52.E08.1.454.light.4.raw
catagtagtgcacgaccggtgctcgatttagtcgagctctcagagagaaagggggagctgctcagttaggacccagagggaaccatggaaaccccagcgcagcttctcttcctcctgctactctggctcccaggtaccaccggagaaattgtgttgacacagtctccaggcaccctgtctttgtctccaggggaaagagccaccctctcctgcagggccagtcagagtgttaacaacaactacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcagcagtatgtgcccgccggcgtcagttcggtcggagggaccgaaggttaggtagagtcaaacgaacgtagtggcgtgcgaccacta

SEQ ID NO: 538082 - DNA, 497 bp, Homo sapiens; identical to SEQ ID NO: 536371
  misc_feature: HIJSMM301BF6R0.16.78.H01.1.454.light.4.raw

SEQ ID NO: 538083 - DNA, 492 bp, Homo sapiens
  misc_feature: HIJSMM301EQQ65.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccgaagtggaaatcaaacgaactgtggctgcaccatctgtcttcatcttcccgccat

SEQ ID NO: 538084 - DNA, 454 bp, Homo sapiens; identical to SEQ ID NO: 534964
  misc_feature: HIJSMM301BMFFE.19.86.H09.1.454.light.4.raw

SEQ ID NO: 538085 - DNA, 467 bp, Homo sapiens
  misc_feature: HIJSMM301D4Q5G.48.23.C01.1.454.light.4.raw
agtatacatacacgaccggtgctcgatttagtacacgtgattagggattgggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagtagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 538086 - DNA, 505 bp, Homo sapiens; identical to SEQ ID NO: 536254
  misc_feature: HIJSMM301ARCTI.7.71.G05.1.454.light.4.raw

SEQ ID NO: 538087 - DNA, 521 bp, Homo sapiens
  misc_feature: HIJSMM301AGQDX.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgtcggtccaacggaccgaacggtaggaagtacgaaacgaaactagtaggcgtgcaccactctgtcttctactcttcccgtccctact

SEQ ID NO: 538088 - DNA, 515 bp, Homo sapiens
  misc_feature: HIJSMM301DP5CC.41.41.D08.1.454.light.4.raw
tctatactatcacgaccggtgctcgatttagtcacgcgagaaagggaaaggggcttcagctgtgggtagagaagacaggactcaggacaatctccagcatggccagcttccctctcctcctcaccctcctcactcactgtgcagggtcctgggcccagtctgtgctgactcagtcaccctctgcgtctgggacccccgggcagagggtcaccatgtattgtgctgggagcaggtccaacatcggacgtaatactgtgagttggtatcagcaagtcccaggaacggcccccaaactcctcgtttctggaaacaatcagcggccctcaggagtccctgagcgattctctggctccaagtctggcacctcagcctccctggccatcagagggctccagtccgaggatgagggtgtttattattgtgcagtctgggatgacagtctgaatggtcattgggtgttcggcggagggaccaagttgaccgtcctaggtcacgcccccaggctcgccccctcc

SEQ ID NO: 538089 - DNA, 493 bp, Homo sapiens
  misc_feature: HIJSMM301EZGTC.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaactgtggctgcacatctgtcttcat

SEQ ID NO: 538090 - DNA, 504 bp, Homo sapiens
  misc_feature: HIJSMM301AQQ4P.18.78.H01.1.454.light.4.raw
  modified_base (415)..(415): a, c, t, g, unknown or other
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattacngcagctcatatacaagcagcagcactcaagtcttcggaactgggaccaaggtcaccgtcctaggtcagcccaaggcccaacccatgtca

SEQ ID NO: 538091 - DNA, 522 bp, Homo sapiens
  misc_feature: HIJSMM301A5393.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 538092 - DNA, 505 bp, Homo sapiens
  misc_feature: HIJSMM301BQ42U.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacgagggaggctgcgattttcggcggagggaccagtctgaccgtccgtaggtcagcccaaggctcgccccctcggtccactcttccg

SEQ ID NO: 538093 - DNA, 497 bp, Homo sapiens
  misc_feature: HIJSMM301B614M.52.55.E11.1.454.light.4.raw
  modified_base (414)..(414): a, c, t, g, unknown or other
cgcagtacgacacgaccggtgctcgatttagcactcgcacgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaanagacaccattggtacttatgtcttcggaactgcgaccaaggtcaccgtcctgggtcagcccaacgccgaaccccactgtcact

SEQ ID NO: 538094 - DNA, 484 bp, Homo sapiens
  misc_feature: HIJSMM301C1ORY.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcacgtcctaggtcagcccaaggccaa

SEQ ID NO: 538095 - DNA, 447 bp, Homo sapiens; identical to SEQ ID NO: 535201
  misc_feature: HIJSMM301CT8W5.18.9.A09.1.454.light.4.raw

SEQ ID NO: 538096 - DNA, 476 bp, Homo sapiens
  misc_feature: HIJSMM301ARCZ0.3.2.A02.1.454.light.4.raw
agacgcactccacgaccggtgctcgatttagactcatctacaggggagtcagtctcagtcaggacacagcatggacatgagggtccccgctcagctcctggggctcctgctactctggctccgaggtgccagatgtgacatccagatgacccagtctccttcctccctgtctgcatctgtgggagacagagtcaccctcacttgccggccaagtcacagcattagcatctatttaaattggtatcaacagaagccagggaaagcccctaacctcctgatctatactgcatccagtttgcaaagtggagtcccatcaaggttcagtggcagtggatctgggacagagttcactctcaccatcagcagtctgcaacctgaagattttgcaacttactactgtcaacagagttacagtatccctccaaccttcggcggagggaccaaggtggagatcaaacgaactgtggctgcaccat

SEQ ID NO: 538097 - DNA, 510 bp, Homo sapiens
  misc_feature: HIJSMM301DAVYU.9.37.D04.1.454.light.4.raw
tgatacgtctcacgaccggtgctcgatttagtagcatactgttgggtttgggggtgtggtggtgcctcagccatggcctggaccgttctcctcctcggcctcctctctcactgcacaggctctgtgacctcctacgtgctgactcagccaccctcggtgtcagtggccccaggaaagacggccaccattacgtgtgggggatacaacattggaagtaaaagtgttcactggtaccagcagaagccaggccaggcccctgtgttggtcgtctatgatgatacagaccggccctcagggatccctgagcgattctctggctccaattctggtgacacggccaccctgatcatcagcagggtcgaggtcgaggatgaggccgactattactgtcaggtgtgggatagtggtactgatcattggtgttcggtggagggaccaagctgaccgtcctaggtcagcccaaggctcgccccctcggtcactctgttcccaccctcctcagacgtatca

SEQ ID NO: 538098 - DNA, 503 bp, Homo sapiens
  misc_feature: HIJSMM301B0Y48.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaggaccaaggtaggaaagtacaaacgaactagtggctgcaccatctgtcttcatcttccccg

SEQ ID NO: 538099 - DNA, 492 bp, Homo sapiens
  misc_feature: HIJSMM301EBM1A.5.57.F02.1.454.light.4.raw
atcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggtccagggaccacagtggatatcaggcgaactgtggctgcaccatctgtctt

SEQ ID NO: 538100 - DNA, 521 bp, Homo sapiens
  misc_feature: HIJSMM301AJ06M.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgacggaccgaacggtaggaagtacgaaacgaaactacgtaggcgtgcaccactactgtcttctactcttcccgtcccacta

SEQ ID NO: 538101 - DNA, 445 bp, Homo sapiens; identical to SEQ ID NO: 537719
  misc_feature: HIJSMM301DIYO7.47.85.H08.1.454.light.4.raw

SEQ ID NO: 538102 - DNA, 470 bp, Homo sapiens
  misc_feature: HIJSMM301BS5Z8.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctggacgttcgccaaggaccaaggtggaaagtcaaacgaa

SEQ ID NO: 538103 - DNA, 491 bp, Homo sapiens
  misc_feature: HIJSMM301BSEUU.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcagggtcccgtggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtcactctgttcccgccctcctctacgtgagct

SEQ ID NO: 538104 - DNA, 495 bp, Homo sapiens; identical to SEQ ID NO: 535731
  misc_feature: HIJSMM301A9S8U.16.78.H01.1.454.light.4.raw

SEQ ID NO: 538105 - DNA, 515 bp, Homo sapiens
  misc_feature: HIJSMM301DEVKD.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggcccaaccccactgtcactctgttccccaccctcctcgac

SEQ ID NO: 538106 - DNA, 495 bp, Homo sapiens
  misc_feature: HIJSMM301AFR87.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaaggaccaaggtggaagtcaacgaactagtggctgcaccatctgtcttctatcttcccgt

SEQ ID NO: 538107 - DNA, 353 bp, Homo sapiens; identical to SEQ ID NO: 536338
  misc_feature: HIJSMM301ENZMQ.3.11.A11.1.454.light.4.raw

SEQ ID NO: 538108 - DNA, 503 bp, Homo sapiens
  misc_feature: HIJSMM301ATEE2.19.71.G05.1.454.light.4.raw
tactctcgtgcacgaccggtgctcgatttagtgtcgtcgcaagagagagggggggggtacgaacaggcaggcaggggcgagcaagaatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaactacttagcttggtaccagcagagaccaggacagcctcctaggctgctcatttactgggcatctaccccgggaatccggggtccctgaccgattcagtggcagcgggtctgggacagatttcactctcaccatcagcagcctgcaggctgaagatgtggcagtttattattgtcaacaaatattattatacttcgtggacgttcggtccaagggaccgaaggtagggatatacagacgaactagtggc

SEQ ID NO: 538109 - DNA, 501 bp, Homo sapiens
  misc_feature: HIJSMM301ASHNP.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaatgaccgtcctaggtcagcccaa

SEQ ID NO: 538110 - DNA, 486 bp, Homo sapiens; identical to SEQ ID NO: 535523
  misc_feature: HIJSMM301C1JSJ.22.73.G07.1.454.light.4.raw

SEQ ID NO: 538111 - DNA, 493 bp, Homo sapiens
  misc_feature: HIJSMM301APMKI.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccagggacccaggtggagatcagacgaactgtggctgcaccatctgtcttcatctcccg

SEQ ID NO: 538112 - DNA, 481 bp, Homo sapiens
  misc_feature: HIJSMM301BTV69.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaa

SEQ ID NO: 538113 - DNA, 519 bp, Homo sapiens
  misc_feature: HIJSMM301DQCE1.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcct

SEQ ID NO: 538114 - DNA, 508 bp, Homo sapiens
  misc_feature: HIJSMM301AK8OK.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttatactgtcaacagcgtagcagcaggcctccggcgacgttcggccaaggaccaaggtggaagtcaagcgaactgtggctgcaccatctgtctttatcttcccgccat

SEQ ID NO: 538115 - DNA, 460 bp, Homo sapiens; identical to SEQ ID NO: 537107
  misc_feature: HIJSMM301DTFI5.22.28.C06.1.454.light.4.raw

SEQ ID NO: 538116 - DNA, 500 bp, Homo sapiens
  misc_feature: HIJSMM301EJI0E.48.23.C01.1.454.light.4.raw
agtatacatacacgaccggtgctcgatttagtacacgtgattagggattgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatt

SEQ ID NO: 538117 - DNA, 511 bp, Homo sapiens
  misc_feature: HIJSMM301D9H9O.16.46.E02.1.454.light.4.raw
tgtactactccacgaccggtgctcgatttagactcatctacagggaaaggggggagtctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctcg

SEQ ID NO: 538118 - DNA, 444 bp, Homo sapiens
  misc_feature: HIJSMM301C5ZK2.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcacctgggctccgggctgaggatgaggctgattattactgccaggcccttgacaacagtttgggtgtttgggtgttcggcggagggaccaagctgaccgtcctaagtcagcccaaggctgcccctcggtcactctgttcccaccctcctccgtgtctgat

SEQ ID NO: 538119 - DNA, 492 bp, Homo sapiens; identical to SEQ ID NO: 537645
  misc_feature: HIJSMM301EMCYS.41.72.G06.1.454.light.4.raw

SEQ ID NO: 538120 - DNA, 477 bp, Homo sapiens; identical to SEQ ID NO: 535122
  misc_feature: HIJSMM301ET742.26.72.G06.1.454.light.4.raw

SEQ ID NO: 538121 - DNA, 493 bp, Homo sapiens; identical to SEQ ID NO: 536471
  misc_feature: HIJSMM301CYZN1.3.71.G05.1.454.light.4.raw

SEQ ID NO: 538122 - DNA, 487 bp, Homo sapiens
  misc_feature: HIJSMM301D55O5.5.48.E04.1.454.light.4.raw
atcagacacgcacgaccggtgctcgatttagagagcgtcacagagagaaggggagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagactttgcgctgtatttctgtcagcagtatgtttcgctacctttcactttcggcggagggaccaaggtggagagcagacgaactgtggctgcaccatctgtcttcatcttcccgccat

SEQ ID NO: 538123 - DNA, 520 bp, Homo sapiens
  misc_feature: HIJSMM301B52CU.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccacggaccgaacggtaggaaggtacgaaacgaactacgtaggcgtgcgaccaatctcgtcttctatcttccgtccctact

SEQ ID NO: 538124 - DNA, 493 bp, Homo sapiens; identical to SEQ ID NO: 535745
  misc_feature: HIJSMM301AWA6S.47.78.H01.1.454.light.4.raw

SEQ ID NO: 538125 - DNA, 514 bp, Homo sapiens
  misc_feature: HIJSMM301APGS5.11.57.F02.1.454.light.4.raw
cgagagataccacgaccggtgctcgatttagctcgatatagttgggtttgggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccgaaggtggaaggtcaagcgaactgtggctgcaccactctgtcttcactcttcccgcccact

SEQ ID NO: 538126 - DNA, 465 bp, Homo sapiens
  misc_feature: HIJSMM301BHE54.4.23.C01.1.454.light.4.raw
agcactgtagcacgaccggtgctcgatttagtacacgtgattagggattggggagtcccaaccaggacacagcatggacatgagggtccctgctcagctcctggggctcctgctgctctggctctcaggtgccagatgtgacatccagatgacccagtctccatcctccctgtctgcttctgtaggagacagagtcaccatcacttgccaggcgagtcaggacattaacaactatttaatttggtatcagcagaaaccaggccatgcccctaggctcctgatctacgatgcatcccatttggaaacaggggtcccatcaaggttcagtggaggtggatatgggacagattttactttctaccatcagcagcctgcagcctgaagatactgcaacatattactgtcaacagtatgataatctgccgctcactttcggcggagggaccaaggtggagatcaagagaa

SEQ ID NO: 538127 - DNA, 503 bp, Homo sapiens; identical to SEQ ID NO: 536834
  misc_feature: HIJSMM301AHE24.2.35.D02.1.454.light.4.raw

SEQ ID NO: 538128 - DNA, 495 bp, Homo sapiens; identical to SEQ ID NO: 536020
  misc_feature: HIJSMM301D5OZN.41.38.D05.1.454.light.4.raw

SEQ ID NO: 538129 - DNA, 509 bp, Homo sapiens
  misc_feature: HIJSMM301C9GD4.48.34.D01.1.454.light.4.raw
agtatacatacacgaccggtgctcgatttagatcgtctgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccacggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccacctttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgtt

SEQ ID NO: 538130 - DNA, 490 bp, Homo sapiens; identical to SEQ ID NO: 537951
  misc_feature: HIJSMM301AMGWZ.19.57.F02.1.454.light.4.raw

SEQ ID NO: 538131 - DNA, 486 bp, Homo sapiens; identical to SEQ ID NO: 535043
  misc_feature: HIJSMM301BN2L6.46.35.D02.1.454.light.4.raw

SEQ ID NO: 538132 - DNA, 503 bp, Homo sapiens
  misc_feature: HIJSMM301D1SO6.14.86.H09.1.454.light.4.raw
cgtctagtaccacgaccggtgctcgatttagtgctatagacttgggtttggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagctccctagagcctggagattttgtagtttattactgtcagcagtatagcagctggcctcccactttcggcggagggaccaaggtggagatccaacgaactgtggctgcaccatctgtcttcatcttccccg

SEQ ID NO: 538133 - DNA, 490 bp, Homo sapiens
  misc_feature: HIJSMM301BF7IZ.43.60.F05.1.454.light.4.raw
tgtgagtagtcacgaccggtgctcgatttagtacgtcatcagggaaagggggcgaggagtcagacccactcaggacacagcatggacatgagggtccccgctcagctcctgggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaatggagtcccatcaagattcagcggcagtggatctggcacagctttcactctcaccgtcagcagcctgcagtctgaagattttgcaacttattactgtctacaagattcttcttaccctcggacgttcggtccacgggaccgacggtggatggtcaagcgaacgtgtggcgtgcaccta

SEQ ID NO: 538134 - DNA, 497 bp, Homo sapiens; identical to SEQ ID NO: 534982
  misc_feature: HIJSMM301A1JQ2.26.80.H03.1.454.light.4.raw

SEQ ID NO: 538135 - DNA, 493 bp, Homo sapiens; identical to SEQ ID NO: 535084
  misc_feature: HIJSMM301BK37R.47.64.F09.1.454.light.4.raw

SEQ ID NO: 538136 - DNA, 493 bp, Homo sapiens
  misc_feature: HIJSMM301AFCQV.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccgagggtggagatcaaacgaactgtggctgcaccatctgtcttcat

SEQ ID NO: 538137 - DNA, 505 bp, Homo sapiens; identical to SEQ ID NO: 535503
  misc_feature: HIJSMM301D98OR.8.28.C06.1.454.light.4.raw

SEQ ID NO: 538138 - DNA, 483 bp, Homo sapiens
  misc_feature: HIJSMM301BF2AY.41.34.D01.1.454.light.4.raw
tctatactatcacgaccggtgctcgatttagatcgtctgtgttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcacca

SEQ ID NO: 538139 - DNA, 487 bp, Homo sapiens
  misc_feature: HIJSMM301BNUO8.13.5.A05.1.454.light.4.raw
tcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattgggttctaatcgggcctccgggtccctaacaggttcagtggcagtggatcaggcacagattttacactgaaaatcagcagagtggaggctgaggatgttggggtttattactgcatgcaagctctacaacctctgcggactttcggccctcggaccg

SEQ ID NO: 538140 - DNA, 490 bp, Homo sapiens; identical to SEQ ID NO: 535936
  misc_feature: HIJSMM301CKSBT.16.68.G02.1.454.light.4.raw

SEQ ID NO: 538141 - DNA, 508 bp, Homo sapiens
  misc_feature: HIJSMM301AN5Q1.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggaggatcaaacgaactagtggctgcaccatctgtt

SEQ ID NO: 538142 - DNA, 505 bp, Homo sapiens
  misc_feature: HIJSMM301CGEO2.14.86.H09.1.454.light.4.raw
cgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagctccctagagcctggagattttgtagtttattactgtcagcagtatagcagctggcctcccactttcggcggagggaccaagggtggagatccaacgaactgtggctgcaccatctgtcttcatcttccccg

SEQ ID NO: 538143 - DNA, 491 bp, Homo sapiens; identical to SEQ ID NO: 535176
  misc_feature: HIJSMM301BCV6H.13.39.D06.1.454.light.4.raw

SEQ ID NO: 538144 - DNA, 442 bp, Homo sapiens
  misc_feature: HIJSMM301C0NYN.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctccctggccatcactgggcttcaggctgaggacgaggctgattattactgctgctcatatgcagatggtgacactcccgtggtattcggcggagggaccaaggtgaccgtcctaggtcagcccaaggctgccccctggtcactctgttcccgccctcctcagacgtatca

SEQ ID NO: 538145 - DNA, 494 bp, Homo sapiens; identical to SEQ ID NO: 534992
  misc_feature: HIJSMM301A655Y.9.1.A01.1.454.light.4.raw

SEQ ID NO: 538146 - DNA, 506 bp, Homo sapiens
  misc_feature: HIJSMM301AH1P0.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctctacttcggtcggacgggacgaacggacggacgatcacgacgaaccgtagttggcgtcgcgaccaactctcgttcttcta

SEQ ID NO: 538147 - DNA, 489 bp, Homo sapiens; identical to SEQ ID NO: 535091
  misc_feature: HIJSMM301EUB2K.47.36.D03.1.454.light.4.raw

SEQ ID NO: 538148 - DNA, 445 bp, Homo sapiens
  misc_feature: HIJSMM301AQRHR.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtcccgtgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccgccctcctccgtgtctgat

SEQ ID NO: 538149 - DNA, 496 bp, Homo sapiens
  misc_feature: HIJSMM301CGZJO.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgt

SEQ ID NO: 538150 - DNA, 494 bp, Homo sapiens
  misc_feature: HIJSMM301DJO6C.11.60.F05.1.454.light.4.raw
cgagagataccacgaccggtgctcgatttagtacgtcatcagggaaaggggaggaactgctcagttaggacccagacggaaccatggaagccccagcgcagcttctcttcctcctgctactctggctcccagataccactggagaaattgtgatgacgcagtctccagccaccctgtctgtgtctccaggggaaagagccaccctctcctgcagggccagtcagagtattagcagcaacttagcctggtaccaacaaaacctggccaggctcccaggctcctcttctatggtgcatccaacagggccgctggtatcccagccaggttcagtggcagtgggtctgcgacagagttcactctcaccatcagcagtctgcagtctgaagattttgcagtttattactgtcagcagtataatgactggcctcccacgtggacgttggccaagggaccaaggtggaaatcaaacgaactgtggctgcaccatctgtctt

SEQ ID NO: 538151 - DNA, 491 bp, Homo sapiens
  misc_feature: HIJSMM301DBVCU.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccgggtccctgacaggttcagtggcagtggatcaggcacagattttacactgaaaatcagcagagtggaggctgaggatgttggggtttattactgcatgcaagctctacaaactccttacacttttggccagggaccaagctggagatcaaacgaactgtgg

SEQ ID NO: 538152 - DNA, 505 bp, Homo sapiens; identical to SEQ ID NO: 535503
  misc_feature: HIJSMM301B1FE3.8.28.C06.1.454.light.4.raw

SEQ ID NO: 538153 - DNA, 514 bp, Homo sapiens
  misc_feature: HIJSMM301AJGF0.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtccttggtcagcccaaggctgccccctcggtcactctgttcccaccct

SEQ ID NO: 538154 - DNA, 505 bp, Homo sapiens
  misc_feature: HIJSMM301DTIHJ.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccactgt

SEQ ID NO: 538155 - DNA, 479 bp, Homo sapiens; identical to SEQ ID NO: 535188
  misc_feature: HIJSMM301AVZ53.10.74.G08.1.454.light.4.raw

SEQ ID NO: 538156 - DNA, 513 bp, Homo sapiens
  misc_feature: HIJSMM301A8W0O.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggtttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccgccctcctcgagtagtaca

SEQ ID NO: 538157 - DNA, 484 bp, Homo sapiens
  misc_feature: HIJSMM301D1BR9.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccggggacacggctggaaactaaacgaactgtggctgcacc

SEQ ID NO: 538158 - DNA, 502 bp, Homo sapiens
  misc_feature: HIJSMM301B9UBS.5.86.H09.1.454.light.4.raw
atcagacacgcacgaccggtgctcgatttagtgctatagacttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtca

SEQ ID NO: 538159 - DNA, 480 bp, Homo sapiens
  misc_feature: HIJSMM301B70EM.13.8.A08.1.454.light.4.raw
tcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcgggtcccatcaaggttccgtggcagtggatctgggacagatttcactctcaccatcaccagtctgcaacctgaagactgtgcaacttactactgccaacagtcttacggaacctcgtacacttttggccagggaccaggctggagatcaaacgaactgtggctgcaccatctgtt

SEQ ID NO: 538160 - DNA, 502 bp, Homo sapiens
  misc_feature: HIJSMM301E0SD9.2.76.G10.1.454.light.4.raw
  modified_base (462)..(462): a, c, t, g, unknown or other
acgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaaccgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtncttatctcttcggacctgggaccaaggtcaccgtccttgg

SEQ ID NO: 538161 - DNA, 472 bp, Homo sapiens; identical to SEQ ID NO: 537757
  misc_feature: HIJSMM301AVRJR.51.78.H01.1.454.light.4.raw

SEQ ID NO: 538162 - DNA, 416 bp, Homo sapiens
  misc_feature: HIJSMM301DVHIG.18.78.H01.1.454.light.4.raw
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagccccaaggccaaccccactgtcactctgttcccgccctcctccatactcgta

SEQ ID NO: 538163 - DNA, 485 bp, Homo sapiens; identical to SEQ ID NO: 536576
  misc_feature: HIJSMM301EHIOQ.46.35.D02.1.454.light.4.raw

SEQ ID NO: 538164 - DNA, 487 bp, Homo sapiens
  misc_feature: HIJSMM301CQM94.10.53.E09.1.454.light.4.raw
catagtagtgcacgaccggtgctcgatttagagagagtgtgttgggtttggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctggaccaaagtggagatcaaacgaactgt

SEQ ID NO: 538165 - DNA, 493 bp, Homo sapiens; identical to SEQ ID NO: 537281
  misc_feature: HIJSMM301D7BD9.9.1.A01.1.454.light.4.raw

SEQ ID NO: 538166 - DNA, 448 bp, Homo sapiens
  misc_feature: HIJSMM301AFG7F.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttcccgccctcctccatactcgta

SEQ ID NO: 538167 - DNA, 523 bp, Homo sapiens
  misc_feature: HIJSMM301BN72F.5.27.C05.1.454.light.4.raw
atcagacacgcacgaccggtgctcgatttagacgcgatcgaagggtttggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccgggatgaggccgactattactgtcaggtgtggaatggtgattatgattatgtcttcggaactgggaccaaggtacaccgtcctaggtcagcccaaggccaaccccacctgtcactctgttcccgccctcctccgtcgtc

SEQ ID NO: 538168 - DNA, 486 bp, Homo sapiens
  misc_feature: HIJSMM301C837O.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggaggaccaaggtggagatcaaacgaactgt

SEQ ID NO: 538169 - DNA, 444 bp, Homo sapiens; identical to SEQ ID NO: 534993
  misc_feature: HIJSMM301BEMJE.5.9.A09.1.454.light.4.raw

SEQ ID NO: 538170 - DNA, 445 bp, Homo sapiens
  misc_feature: HIJSMM301EGO7W.49.73.G07.1.454.light.4.raw
agtcgagagacacgaccggtgctcgatttagctctacgctcctgcgtgctctggctctcaggtgccagatgtatcatccagatgacccagtctccatcctccctgtctgcatctataggagacagaatcaccatcacttgccgggcgagtcaggacattagcgtgtatctgaattggtatcagcaaaaccagggaaagccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccaaggtggaggatcaaacgaactgtggctgcaccatctgtcttcatcttccgccatctgatctctcgact

SEQ ID NO: 538171 - DNA, 481 bp, Homo sapiens
  misc_feature: HIJSMM301EY2C0.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctgtcttcatcttccgccatctgagctacg

SEQ ID NO: 538172 - DNA, 444 bp, Homo sapiens; identical to SEQ ID NO: 535594
  misc_feature: HIJSMM301B8RWC.9.9.A09.1.454.light.4.raw

SEQ ID NO: 538173 - DNA, 499 bp, Homo sapiens
  misc_feature: HIJSMM301BXR2T.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcacgcccaagga

SEQ ID NO: 538174 - DNA, 501 bp, Homo sapiens
  misc_feature: HIJSMM301C82M9.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagctttacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcat

SEQ ID NO: 538175 - DNA, 382 bp, Homo sapiens; identical to SEQ ID NO: 536844
  misc_feature: HIJSMM301CR98W.41.28.C06.1.454.light.4.raw

SEQ ID NO: 538176 - DNA, 507 bp, Homo sapiens; identical to SEQ ID NO: 535930
  misc_feature: HIJSMM301ECHMS.15.34.D01.1.454.light.4.raw

SEQ ID NO: 538177 - DNA, 486 bp, Homo sapiens; identical to SEQ ID NO: 535043
  misc_feature: HIJSMM301A4BCO.46.35.D02.1.454.light.4.raw

SEQ ID NO: 538178 - DNA, 507 bp, Homo sapiens
  misc_feature: HIJSMM301EZ6V1.8.42.D09.1.454.light.4.raw
ctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccc

SEQ ID NO: 538179 - DNA, 488 bp, Homo sapiens
  misc_feature: HIJSMM301C4EUX.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtatccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtcagaccccg

SEQ ID NO: 538180 - DNA, 456 bp, Homo sapiens
  misc_feature: HIJSMM301D2L5E.19.86.H09.1.454.light.4.raw
tactctcgtgcacgaccggtgctcgatttagtgctatagacttgggtttggggccgttcctgggcccagtctgtgctgactcaggcacccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggtttcggcggagggacaagctgaccgtcctaagtcagcccaaggctcgcccccgtcggtcactctcgttcccaccctcctccacgagagta

SEQ ID NO: 538181 - DNA, 489 bp, Homo sapiens
  misc_feature: HIJSMM301BG2VO.10.20.B09.1.454.light.4.raw
catagtagtgcacgaccggtgctcgatttagtgtagtgtgaagggggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaagtggatttcagacgaactgtggctgcaccatctgtcttcat

SEQ ID NO: 538182 - DNA, 447 bp, Homo sapiens; identical to SEQ ID NO: 535201
  misc_feature: HIJSMM301B5J90.18.9.A09.1.454.light.4.raw

SEQ ID NO: 538183 - DNA, 463 bp, Homo sapiens; identical to SEQ ID NO: 535062
  misc_feature: HIJSMM301EEUCC.11.73.G07.1.454.light.4.raw

SEQ ID NO: 538184 - DNA, 474 bp, Homo sapiens
  misc_feature: HIJSMM301BQIFI.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccc

SEQ ID NO: 538185 - DNA, 496 bp, Homo sapiens
  misc_feature: HIJSMM301B4I74.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacagtccacgagtgacccaggtctccgatccgtccctggtcctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaaccttgaggattttgcaacttactaactgtcaacagagttacaggcccccctatacttttggccaggggaccaagctggagatcacaggaactgtggctgcacc

SEQ ID NO: 538186 - DNA, 509 bp, Homo sapiens
  misc_feature: HIJSMM301BKIA4.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccaacggaccgaacggtaggaaagtcaagacgaactgtggctgcaccactctgtcttctatcttcccgt

SEQ ID NO: 538187 - DNA, 486 bp, Homo sapiens; identical to SEQ ID NO: 535385
  misc_feature: HIJSMM301CVP53.19.71.G05.1.454.light.4.raw

SEQ ID NO: 538188 - DNA, 441 bp, Homo sapiens
  misc_feature: HIJSMM301EH7B0.2.76.G10.1.454.light.4.raw
acgctcgacacacgaccggtgctcgatttagtcactcatacagggtcctgggcccagtctgtgctgactcagccaccctcagcgtctgggccccccggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctctgtagcgt

SEQ ID NO: 538189 - DNA, 487 bp, Homo sapiens
  misc_feature: HIJSMM301EEWOF.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccgaaggtggagatcaaacgaactgtggctgcaccat

SEQ ID NO: 538190 - DNA, 487 bp, Homo sapiens
  misc_feature: HIJSMM301D5AEQ.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgt

SEQ ID NO: 538191 - DNA, 512 bp, Homo sapiens
  misc_feature: HIJSMM301CWPNZ.48.37.D04.1.454.light.4.raw
agtatacatacacgaccggtgctcgatttagtagcatactgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcaatgcgattttcggcggagggaccaaggctgaccgtcctgggtcagcccaaggctgcccctcggtcactctgttcccgcct

SEQ ID NO: 538192 - DNA, 503 bp, Homo sapiens
  misc_feature: HIJSMM301BY173.47.65.F10.1.454.light.4.raw
agctcacgtacacgaccggtgctcgatttagctacgctctaaggggagctgtgggtagagaagacaggactcaggacaatctccagcatggccagcttccctctcctcctcaccctcctcactcactgtgcagggtcctgggcccagtctgcgttgactcagccaccctcagtgtctgggacccccgggcagacggtcgccgtctcttgttctggaagcggctccaacatcggccgtaattctgtaaactggtaccagcagctcccaggaatggcccccacactcctcatctatagggatgatcagtggccctcaggggtccctgaccgattctctggctccaagtctggcacttcagcctccctggccatcagtgggctccagtctggggatgaggctgattattactgtgcaacatgggatgacagtctgaacgcaatggtgttcggcggagggaccaaggtggccgtcctaggtcagcccaaggctgccccctggtcact

SEQ ID NO: 538193 - DNA, 489 bp, Homo sapiens
  misc_feature: HIJSMM301AP8M1.48.10.A10.1.454.light.4.raw
agtatacatacacgaccggtgctcgatttagcgtcgatctcaggggagacccagtcagaacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaaggaccgacgggtggaaagtacaaacgaactagtggctgcaccactctgtcttctat

SEQ ID NO: 538194 - DNA, 485 bp, Homo sapiens
  misc_feature: HIJSMM301BQ935.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctggaccaaagtggatatcaaacgaactgtggctgcaccatctgtt

SEQ ID NO: 538195 - DNA, 503 bp, Homo sapiens
  misc_feature: HIJSMM301DBANK.51.23.C01.1.454.light.4.raw
cgatcgtatacacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagatcaaacgaactgtggctgcaccatctgtcttcatcttcccgcat

SEQ ID NO: 538196 - DNA, 454 bp, Homo sapiens; identical to SEQ ID NO: 534964
  misc_feature: HIJSMM301CXA99.19.86.H09.1.454.light.4.raw

SEQ ID NO: 538197 - DNA, 491 bp, Homo sapiens; identical to SEQ ID NO: 535315
  misc_feature: HIJSMM301CJEEB.14.55.E11.1.454.light.4.raw

SEQ ID NO: 538198 - DNA, 494 bp, Homo sapiens; identical to SEQ ID NO: 535276
  misc_feature: HIJSMM301DOYZ9.16.6.A06.1.454.light.4.raw

SEQ ID NO: 538199 - DNA, 496 bp, Homo sapiens
  misc_feature: HIJSMM301ARPAP.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagttttttactgtcagcagtatagtaactggcctccgtacacttttggccaggggaccaagctagaaatcaaacgaactgtggctgcaccatctgtcttcta

SEQ ID NO: 538200 - DNA, 486 bp, Homo sapiens
  misc_feature: HIJSMM301EBR3U.21.55.E11.1.454.light.4.raw
tcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacacctttttaaattggtatcagcacaaaccagggaaggccccaaagctcctgatcgatgctgcatccaatttagagagtggggtcccatccaggttcagtggcgatggatctgggacaaatttcactctcaccatcagcagtctgcaacctgaagattttgcaacttactattgtcaacagagttacagtattcctttcactttcggccctggaccgaagtcgatatcaaacgaactgtggctgcaccatctgt

SEQ ID NO: 538201 - DNA, 487 bp, Homo sapiens; identical to SEQ ID NO: 536536
  misc_feature: HIJSMM301BA20I.26.45.E01.1.454.light.4.raw

SEQ ID NO: 538202 - DNA, 485 bp, Homo sapiens
  misc_feature: HIJSMM301DS6RW.15.8.A08.1.454.light.4.raw
  modified_base (356)..(356): a, c, t, g, unknown or other
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagnttttgctagtttattactgtcagcaatataacaagtggccattcactttcggcccagggaccaaagtggatatcaaacgaactgtggctgcaccatctgtcttcatccttcccgccatctgagctaacg

SEQ ID NO: 538203 - DNA, 447 bp, Homo sapiens; identical to SEQ ID NO: 535201
  misc_feature: HIJSMM301AULL1.18.9.A09.1.454.light.4.raw

SEQ ID NO: 538204 - DNA, 479 bp, Homo sapiens
  misc_feature: HIJSMM301CL8U4.51.60.F05.1.454.light.4.raw
cgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtctcggtcagcccaaggctcg

SEQ ID NO: 538205 - DNA, 444 bp, Homo sapiens; identical to SEQ ID NO: 535192
  misc_feature: HIJSMM301CYGMG.5.9.A09.1.454.light.4.raw

SEQ ID NO: 538206 - DNA, 490 bp, Homo sapiens
  misc_feature: HIJSMM301AKAA3.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctaccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccgaaggtggaaatacaaacgaactgtggctgcaccat

SEQ ID NO: 538207 - DNA, 506 bp, Homo sapiens
  misc_feature: HIJSMM301DJUJL.17.87.H10.1.454.light.4.raw
cgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaggcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggaggcaccaaggtgaccgtcctaggtcagcccaaggctgccccctcggtcta

SEQ ID NO: 538208 - DNA, 499 bp, Homo sapiens
  misc_feature: HIJSMM301BZ13G.40.65.F10.1.454.light.4.raw
tctagcgactcacgaccggtgctcgatttagctacgctctaagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccg

SEQ ID NO: 538209 - DNA, 488 bp, Homo sapiens; identical to SEQ ID NO: 535081
  misc_feature: HIJSMM301D8FKJ.26.23.C01.1.454.light.4.raw

SEQ ID NO: 538210 - DNA, 493 bp, Homo sapiens; identical to SEQ ID NO: 536471
  misc_feature: HIJSMM301EEP56.3.71.G05.1.454.light.4.raw

SEQ ID NO: 538211 - DNA, 484 bp, Homo sapiens
  misc_feature: HIJSMM301EZFOP.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccgccctcctctacgtgagct

SEQ ID NO: 538212 - DNA, 491 bp, Homo sapiens
  misc_feature: HIJSMM301AHHI3.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaagcctggccaggctcccagactcctcatctctggtgcatcttcgagggccactggtgtcccagccaggttcagtggcagtgggtctggaacagagttcactctcaccatcagtggcctgcagtctgaagattttgcagtttattactgtcagcagtataatgactgggttttattcactttcggccctgggaccaaagtggatttcagacgaactgtggctgcaccatctgtcttcta

SEQ ID NO: 538213 - DNA, 510 bp, Homo sapiens
  misc_feature: HIJSMM301BDR8L.40.37.D04.1.454.light.4.raw
tctagcgactcacgaccggtgctcgatttagtagcatactgttgggtttggggactgatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagtatttcacactagaaaatcgacgccggggtgggaggcgtggaggagttggttggggttttattactgcatgctaaggtttacttaccttcctcggtacttccggtccgtcggacgacgagtggagtgtacgaaacgtaacg

SEQ ID NO: 538214 - DNA, 488 bp, Homo sapiens; identical to SEQ ID NO: 537124
  misc_feature: HIJSMM301ANH25.11.25.C03.1.454.light.4.raw

SEQ ID NO: 538215 - DNA, 487 bp, Homo sapiens
  misc_feature: HIJSMM301AHITW.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgtt

SEQ ID NO: 538216 - DNA, 514 bp, Homo sapiens
  misc_feature: HIJSMM301C5JON.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggtcactctgttccc

SEQ ID NO: 538217 - DNA, 487 bp, Homo sapiens
  misc_feature: HIJSMM301BCRYS.41.2.A02.1.454.light.4.raw
tctatactatcacgaccggtgctcgatttagactcatctacagggggcaggagtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcatggtctccccttagtttcggcggagggaccaaggttgagatcaaacgaactgtggctgcaccatctgtctt

SEQ ID NO: 538218 - DNA, 508 bp, Homo sapiens
  misc_feature: HIJSMM301EGLY5.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctgccccctcggcactctgtt

SEQ ID NO: 538219 - DNA, 486 bp, Homo sapiens
  misc_feature: HIJSMM301CZC35.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccagggaccaaactggacatcaaacgaactgtggctgcaccatctgt

SEQ ID NO: 538220 - DNA, 501 bp, Homo sapiens; identical to SEQ ID NO: 535746
  misc_feature: HIJSMM301CBI09.18.11.A11.1.454.light.4.raw

SEQ ID NO: 538221 - DNA, 496 bp, Homo sapiens
  misc_feature: HIJSMM301B4YB1.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaagtcaaacgaaactgtggctgcaccatctgtcttcat

SEQ ID NO: 538222 - DNA, 496 bp, Homo sapiens
  misc_feature: HIJSMM301B60RC.43.60.F05.1.454.light.4.raw
tgtgagtagtcacgaccggtgctcgatttagtacgtcatcagggaaagggggaggtcagacccacctcaggacacagcatggacatgagggtccccgctcagctcctggggcgtcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttacccctcggacgttcggtccacgggaccggaaccggtgggatgtcaacgacggactacgtggctgcaccat

SEQ ID NO: 538223 - DNA, 487 bp, Homo sapiens
  misc_feature: HIJSMM301AVBS8.17.25.C03.1.454.light.4.raw
cgtagactagcacgaccggtgctcgatttagtagtgtagatttgggtttgggggagtcagtctcagtcaggacacagcatggacatgagggtccccgctcagctcctgggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatctgt

SEQ ID NO: 538224 - DNA, 505 bp, Homo sapiens
  misc_feature: HIJSMM301EKS7C.16.46.E02.1.454.light.4.raw
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcact

SEQ ID NO: 538225 - DNA, 455 bp, Homo sapiens
  misc_feature: HIJSMM301AD6IM.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggtcggagggaccaagctgaccgtcctaagtcagcccaaggctgccccctccggtcactctgttcccaccctcctccacgagaga

SEQ ID NO: 538226 - DNA, 506 bp, Homo sapiens
  misc_feature: HIJSMM301BLWGZ.51.55.E11.1.454.light.4.raw
cgatcgtatacacgaccggtgctcgatttagcactcgcacgttgggtttggggtgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtgaggctgaggatgttgggttttattactgcatgcaaggtacacactggcctgggacgttcggccaagggaccaaggtggaaatcaaacgaactgtggctgcaccatctgtcttc

SEQ ID NO: 538227 - DNA, 507 bp, Homo sapiens
  misc_feature: HIJSMM301E2T0O.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctcccacggtacactttggtcgacgggaccgaacgactggaggatacaaacgaaactagtggcgtgcaccactctgtt

SEQ ID NO: 538228 - DNA, 442 bp, Homo sapiens
  misc_feature: HIJSMM301AZJ27.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgtcccgccctcccgacacgcgag

SEQ ID NO: 538229 - DNA, 487 bp, Homo sapiens; identical to SEQ ID NO: 536179
  misc_feature: HIJSMM301EKN2N.19.57.F02.1.454.light.4.raw

SEQ ID NO: 538230 - DNA, 494 bp, Homo sapiens
  misc_feature: HIJSMM301A4GZN.11.71.G05.1.454.light.4.raw
cgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcatt

SEQ ID NO: 538231 - DNA, 472 bp, Homo sapiens
  misc_feature: HIJSMM301CNHLV.9.15.B04.1.454.light.4.raw
  modified_base (454)..(454): a, c, t, g, unknown or other
  modified_base (461)..(461): a, c, t, g, unknown or other
tgatacgtctcacgaccggtgctcgatttagacagtatatatccgcggggggctctgcttcagctgtgggcacaagcggcagcactcaggacaatctccagcatggcctggtctcctctcctcctcactctcctcgctcactgcacagagtcctgggcccagtctgtgctgacgcagccgccctcagtgtctggggccccagggcagagggtcaccatctcctgttctgggagcagctccaacatcgggggagactctgatgcacattggtatcagcagcttccagaagcagcccccaaactcctcatctatgctaacaccaatcggccctcaggggtccctgaccgattctctggctccaagtctggcacctcagcctccctgaccatcagtgaattgcagactgaggatgaggctaactactactgccagtcctccgacagcagcctgggtntttgggngttcggcggac

SEQ ID NO: 538232 - DNA, 481 bp, Homo sapiens; identical to SEQ ID NO: 535993
  misc_feature: HIJSMM301AO1RO.21.25.C03.1.454.light.4.raw

SEQ ID NO: 538233 - DNA, 494 bp, Homo sapiens; identical to SEQ ID NO: 534992
  misc_feature: HIJSMM301AOJDE.9.1.A01.1.454.light.4.raw

SEQ ID NO: 538234 - DNA, 493 bp, Homo sapiens
  misc_feature: HIJSMM301BJFKZ.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatcaacgaactgtggctgcaccatctgtcttcat

SEQ ID NO: 538235 - DNA, 494 bp, Homo sapiens; identical to SEQ ID NO: 534992
  misc_feature: HIJSMM301E1LDB.9.1.A01.1.454.light.4.raw

SEQ ID NO: 538236 - DNA, 484 bp, Homo sapiens; identical to SEQ ID NO: 535400
  misc_feature: HIJSMM301AQ0N0.46.26.C04.1.454.light.4.raw

SEQ ID NO: 538237 - DNA, 488 bp, Homo sapiens; identical to SEQ ID NO: 535861
  misc_feature: HIJSMM301DPNE8.14.55.E11.1.454.light.4.raw

SEQ ID NO: 538238 - DNA, 491 bp, Homo sapiens
  misc_feature: HIJSMM301AHX8Y.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggaggatcagacgaactgtggctgcaccatctgt

SEQ ID NO: 538239 - DNA, 476 bp, Homo sapiens
  misc_feature: HIJSMM301A68MU.48.45.E01.1.454.light.4.raw
agtatacatacacgaccggtgctcgatttagtgagtcagtaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcaggggtccctgctcgcttctctggctccaagtctggcaacacggcctccctgaccatctctgggctccaggctgaagatgaggctgattatttctgctgctcatatgcagccaactattatgtcttcggaactgagaccaaggtcaccgtcct

SEQ ID NO: 538240 - DNA, 485 bp, Homo sapiens; identical to SEQ ID NO: 535880
  misc_feature: HIJSMM301DYS7D.7.75.G09.1.454.light.4.raw

SEQ ID NO: 538241 - DNA, 488 bp, Homo sapiens
  misc_feature: HIJSMM301D19CB.3.72.G06.1.454.light.4.raw
agacgcactccacgaccggtgctcgatttagctacgactgcaagggaaaggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccaaggtggagatcaaacgactgtggctgcaccatctgt

SEQ ID NO: 538242 - DNA, 493 bp, Homo sapiens; identical to SEQ ID NO: 535047
  misc_feature: HIJSMM301AJDWI.16.53.E09.1.454.light.4.raw

SEQ ID NO: 538243 - DNA, 481 bp, Homo sapiens
  misc_feature: HIJSMM301AX57D.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcactttcgcgggggaccgaaggtggagatcaaacgaactgtggctgcaaca

SEQ ID NO: 538244 - DNA, 453 bp, Homo sapiens; identical to SEQ ID NO: 535173
  misc_feature: HIJSMM301ET10M.19.86.H09.1.454.light.4.raw

SEQ ID NO: 538245 - DNA, 507 bp, Homo sapiens
  misc_feature: HIJSMM301D3QVY.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttattgaggtcactaaagcggcccttaggggtccctgatcgcttctctggctccaagtctggcagaacggcctccctgaccgtctctgggctccaagctgaggatgaggctgattattactgcagctcatatgcaggcagcagcaatgtacttttcggtcggagggaccaagctgaccgtcctgggtcagcccaaggctgccccctccggtca

SEQ ID NO: 538246 - DNA, 479 bp, Homo sapiens
  misc_feature: HIJSMM301B1EYN.49.63.F08.1.454.light.4.raw
agtcgagagacacgaccggtgctcgatttagcgatcgtataagggggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcggctatttaaattggtatctgcacagtccagggaaagcccctaaggtcctgatttatgctgcatccagtttgcaaagtggggtcccatcaaggttcattggcagtggatttgggacagatttcactctcaccatcaccagtctgcgacctgaggattttggaacatactactgtcaacacagttacagtataccgtacagttttggccaggggaccaagctggagatcacacgaactgtggctgcaccatctgtcttcatcttcccgcc

SEQ ID NO: 538247 - DNA, 484 bp, Homo sapiens
  misc_feature: HIJSMM301AUN8L.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggtca

SEQ ID NO: 538248 - DNA, 467 bp, Homo sapiens
  misc_feature: HIJSMM301BO2DV.18.76.G10.1.454.light.4.raw
  modified_base (461)..(461): a, c, t, g, unknown or other
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaattcaccatcagcagcctccaacgtgatgatgttgcaacatactattgtcagcaatatgattttgctctccgagtgccacttttggcggggacgaacgtggacatnaacgaa

SEQ ID NO: 538249 - DNA, 494 bp, Homo sapiens
  misc_feature: HIJSMM301D1MS8.40.17.B06.1.454.light.4.raw
tctagcgactcacgaccggtgctcgatttagtcgatagtgaagggggtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatctataaggcgtctagtttagaaagtggggtcccatcaaggatcagcggcagtggatctgggacagaattcactctcaccattagtagcctgcagcctgatgattttgcaacttattactgccaacaatataatgattttccgtggacgttcggccaagggaccaaggtagaaatcaaacgaactgtggctgcaccatctgtcttcatcttcccgcc

SEQ ID NO: 538250 - DNA, 495 bp, Homo sapiens
  misc_feature: HIJSMM301ESHJW.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaacgaaactgtggctgcaccatctgtcttcatt

SEQ ID NO: 538251 - DNA, 493 bp, Homo sapiens
  misc_feature: HIJSMM301B3YO9.40.81.H04.1.454.light.4.raw
tctagcgactcacgaccggtgctcgatttagtagtgtagattcgcgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcagtggatcaggtacagattttacactgaaaatcagcagagtggaggctgaggatgttggggtttattacttgcatgcaacctctacaaactgtgtggacggtcggccaagggaccaaggtggaaatcaagcgaactgtggctgcacc

SEQ ID NO: 538252 - DNA, 503 bp, Homo sapiens
  misc_feature: HIJSMM301EG9IJ.5.24.C02.1.454.light.4.raw
atcagacacgcacgaccggtgctcgatttagtacagatcgttagggaaaggggctggggtctcgaggaaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggcc

SEQ ID NO: 538253 - DNA, 484 bp, Homo sapiens
  misc_feature: HIJSMM301CP8G9.46.35.D02.1.454.light.4.raw
  modified_base (408)..(408): a, c, t, g, unknown or other
actagcagtacacgaccggtgctcgatttagcacacgatagttgggtttggggagctgctcagttaggacccagagggaaccatggaaaccccacgcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattacngtcagcagtatggtcacgtcccaagaactttggccagggaccaagctggagatcaaacgaactgtggctgcaccat

SEQ ID NO: 538254 - DNA, 475 bp, Homo sapiens
  misc_feature: HIJSMM301A2PPZ.51.11.A11.1.454.light.4.raw
cgatcgtatacacgaccggtgctcgatttagctacgactgcaggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttctaccatcagcagcctgcagcctgaagatattgcaacatattactgtcaacagtatgataatctccacctcactttcggtcggagggaccgaaggtggagatcaaacgaaactagtggctgcacc

SEQ ID NO: 538255 - DNA, 473 bp, Homo sapiens
  misc_feature: HIJSMM301CHE72.51.42.D09.1.454.light.4.raw
cgatcgtatacacgaccggtgctcgatttagacacatacgcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagccc

SEQ ID NO: 538256 - DNA, 503 bp, Homo sapiens
  misc_feature: HIJSMM301CNCD2.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttctatcctccgtggacgttcggccaagggaccagggtggaaatcagacgaactgtggctgcaccat

SEQ ID NO: 538257 - DNA, 505 bp, Homo sapiens
  misc_feature: HIJSMM301DL4V4.48.36.D03.1.454.light.4.raw
  modified_base (43)..(43): a, c, t, g, unknown or other
agtatacatacacgaccggtgctcgatttagctgcgtcacganctctcttggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcggggtcccgtgatcgcttctctggctccaagtctggcaacacggcctccctgaccatctctgggctccaggctgaagatcaggctgattattactgctgttcattttctaagttcctttttgtcttcggaactgggaccgaggtcaccgtcctaggtcagcccaaggccaaccccactgtca

SEQ ID NO: 538258 - DNA, 488 bp, Homo sapiens; identical to SEQ ID NO: 536056
  misc_feature: HIJSMM301CWPJ3.47.36.D03.1.454.light.4.raw

SEQ ID NO: 538259 - DNA, 447 bp, Homo sapiens; identical to SEQ ID NO: 535201
  misc_feature: HIJSMM301AO4QD.18.9.A09.1.454.light.4.raw

SEQ ID NO: 538260 - DNA, 506 bp, Homo sapiens
  misc_feature: HIJSMM301DFMWJ.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccgaaagtggatatcaaacgaactgtggctgcaccatctgtctt

SEQ ID NO: 538261 - DNA, 441 bp, Homo sapiens; identical to SEQ ID NO: 535074
  misc_feature: HIJSMM301AG0K0.11.3.A03.1.454.light.4.raw

SEQ ID NO: 538262 - DNA, 504 bp, Homo sapiens; identical to SEQ ID NO: 537659
  misc_feature: HIJSMM301B3CQQ.13.55.E11.1.454.light.4.raw

SEQ ID NO: 538263 - DNA, 497 bp, Homo sapiens
  misc_feature: HIJSMM301E3LMD.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcgtcggaggacgaacggacggacgagtcacgacgaactagtggcgtgcaccaactctcgttcttcta

SEQ ID NO: 538264 - DNA, 497 bp, Homo sapiens
  misc_feature: HIJSMM301CJ88D.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactccgggccagcagtggtaacattgtgatattcggcggagggaccaaggtgaccgtcctacgtcagcccaaggctgccccctcggtcactctccg

SEQ ID NO: 538265 - DNA, 486 bp, Homo sapiens; identical to SEQ ID NO: 535385
  misc_feature: HIJSMM301B2KWF.19.71.G05.1.454.light.4.raw

SEQ ID NO: 538266 - DNA, 494 bp, Homo sapiens; identical to SEQ ID NO: 535828
  misc_feature: HIJSMM301AFJ9K.3.36.D03.1.454.light.4.raw

SEQ ID NO: 538267 - DNA, 465 bp, Homo sapiens
  misc_feature: HIJSMM301AKTZ5.40.48.E04.1.454.light.4.raw
tctagcgactcacgaccggtgctcgatttagagagcgtcacagagagaagggcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatc

SEQ ID NO: 538268 - DNA, 489 bp, Homo sapiens
  misc_feature: HIJSMM301DLI4R.52.83.H06.1.454.light.4.raw
cgcagtacgacacgaccggtgctcgatttagatcacgtgcgtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattgggggaaaatatgcttgctggtatcaacagcggccaggccagtcccctgtactggtcatctatctgaatagtaggcggccctctgggatccctgaccgattctctggctcccactctgggaacacagccactctgaccatcagcgggacccaggctttggatgaggctgactattactgtcaggcgtgggacaccatcactggagtaatattcggcggagggaccaggctgaccgtcctaggtcagcccaaggctgccccctcggt

SEQ ID NO: 538269 - DNA, 495 bp, Homo sapiens
  misc_feature: HIJSMM301DCS6Z.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactagtggctgcaccatctgtcttcatcttccccg

SEQ ID NO: 538270 - DNA, 538 bp, Homo sapiens
  misc_feature: HIJSMM301ASQ2Y.43.81.H04.1.454.light.4.raw
  modified_base (467)..(467): a, c, t, g, unknown or other
tgtgagtagtcacgaccggtgctcgatttagtagtgtagattcgcggggtgggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggaccctgcccggtttcaggctcctccttggggcaaagctgccctgacactgtcaggtgtgcaccctgaggacgaggctgagtattactgtctgctccactttcgtactgcctgggtcttcggcgggggacgtcagtgtaccgtcctggtacncgcccgaacggcgtcgtcccccgtcccggtcgactcgttcgttccccggtcccctccctacctactacctt

SEQ ID NO: 538271 - DNA, 496 bp, Homo sapiens
  misc_feature: HIJSMM301CXIBW.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaagtggaaatcaaacgaactgtggctgcacca

SEQ ID NO: 538272 - DNA, 495 bp, Homo sapiens
  misc_feature: HIJSMM301BBOJ1.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctccggtcactctgttcccaccctcctcgctacgtaga

SEQ ID NO: 538273 - DNA, 490 bp, Homo sapiens
  misc_feature: HIJSMM301AKI1J.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttcccgcc

SEQ ID NO: 538274 - DNA, 520 bp, Homo sapiens
  misc_feature: HIJSMM301CI2BW.7.86.H09.1.454.light.4.raw
cgtgtctctacacgaccggtgctcgatttagtgctatagacttgggtttggggagagctctggagaagagctgctcagttaggaccaagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggacaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttccccg

SEQ ID NO: 538275 - DNA, 470 bp, Homo sapiens; identical to SEQ ID NO: 536130
  misc_feature: HIJSMM301CVI6F.7.81.H04.1.454.light.4.raw

SEQ ID NO: 538276 - DNA, 522 bp, Homo sapiens
  misc_feature: HIJSMM301EF7QC.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgaccgtactacctccgtccgacggaacggacgacgtacgtaggaattaaacgtaaaccgtagtggcgtcgtcgacccaactacttcgttcttcctactt

SEQ ID NO: 538277 - DNA, 495 bp, Homo sapiens
  misc_feature: HIJSMM301B7268.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactgtggcg

SEQ ID NO: 538278 - DNA, 486 bp, Homo sapiens
  misc_feature: HIJSMM301B8KGB.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaagggaccgaagtggaaatacaaacgaactgtggctgcaccta

SEQ ID NO: 538279 - DNA, 492 bp, Homo sapiens
  misc_feature: HIJSMM301B3FHN.52.10.A10.1.454.light.4.raw
cgcagtacgacacgaccggtgctcgatttagcgtcgatctcaggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggctcctcatctatgatgcatccaatcgggccactggcatcccagccaggttcagtggcagtgggtctgggacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgccat

SEQ ID NO: 538280 - DNA, 503 bp, Homo sapiens
  misc_feature: HIJSMM301BCAVB.2.81.H04.1.454.light.4.raw
acgctcgacacacgaccggtgctcgatttagtagtgtagattcgcgggggggtctcaggaggcagcgctctcaggacgtcaccaccatggcctgggctctgctcctcctcaccctcctcactcagggcacagggtcttgggcccagtctgccctgactcagcctccctccgcgtccgggtctcttggacagtcagtcaccatctcctgcactggaaccagcagtgacattggtgattatagacatgtctcctggtaccaacaggaaccaggcaaagccccccgactcataatttatgaggtcaataagcggccctcaggggtccttgatcgcttctctggctccaagtctggcaacacggcctccctgaccgtctctgggctccaggctgacgatgaggctgattattactgcagctcagaagcaggcaccaacaattgggtgttcggcggagggaccaagctgaccgtcttaggtcagcccaaggctgccccctcggtcact

SEQ ID NO: 538281 - DNA, 446 bp, Homo sapiens; identical to SEQ ID NO: 536106
  misc_feature: HIJSMM301EUQ21.18.9.A09.1.454.light.4.raw

SEQ ID NO: 538282 - DNA, 472 bp, Homo sapiens
  misc_feature: HIJSMM301BRQ59.12.49.E05.1.454.light.4.raw
  modified_base (421)..(421): a, c, t, g, unknown or other
  modified_base (437)..(437): a, c, t, g, unknown or other
atacgacgtacacgaccggtgctcgatttagagcgactagcaacacacaaaggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaattttttagcctggtatcagcagaaaccagggaaagttccacacctcctgatctatgctgcatccgctttgcaatcagggtcccatctcggttcagcggcagtggatctgggacagagttcactctcaccatcagcagcctgcagcctgaagatgttgcaacttattactgtcaaaagtntaacagtgcccccttnaccttcggccaagggacacgactggagattagacg

SEQ ID NO: 538283 - DNA, 493 bp, Homo sapiens
  misc_feature: HIJSMM301A67PH.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccagggaccaagctggagatcaaacgaactgtggctgcaccatctgtcttca

SEQ ID NO: 538284 - DNA, 493 bp, Homo sapiens; identical to SEQ ID NO: 536471
  misc_feature: HIJSMM301BCPY5.3.71.G05.1.454.light.4.raw

SEQ ID NO: 538285 - DNA, 491 bp, Homo sapiens
  misc_feature: HIJSMM301CS855.17.25.C03.1.454.light.4.raw
cgtagactagcacgaccggtgctcgatttagtagtgtagatttgggtttgggggagtcagtctcagtcaggacacagcatggacatgagggtccccgctcaactcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaaatctcaccatcaccactctgcaacctgaggattgtgcaatctactactgtcaacagagttacagttcccctcgcacttttggccagggaccaaagttgagatcaaacgaactgtggctgcaccatctgtctt

SEQ ID NO: 538286 - DNA, 506 bp, Homo sapiens
  misc_feature: HIJSMM301B286K.49.65.F10.1.454.light.4.raw
agtcgagagacacgaccggtgctcgatttagctacgctctaaggggctggcctaaggaagcagcactggtggtgcctcagccatggcctggaccgttctcctcctcggcctcctctctcactgcacagtctctgtgacctcctatgtgctgtctcagtcaccctcggtgtcagtggccccaggacagacggccaggattacctgtgggggagacaacattggaaataaaggtgtgcactggtaccagcagatgccaggccaggcccctgtcctggtcgtctttgatgatagcgaccggccctcagggatccctgagcgattctctggctccaactctggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccct

SEQ ID NO: 538287 - DNA, 490 bp, Homo sapiens; identical to SEQ ID NO: 535526
  misc_feature: HIJSMM301ANZHX.26.78.H01.1.454.light.4.raw

SEQ ID NO: 538288 - DNA, 421 bp, Homo sapiens
  misc_feature: HIJSMM301AH83J.18.78.H01.1.454.light.4.raw
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 538289 - DNA, 508 bp, Homo sapiens
  misc_feature: HIJSMM301CGYGM.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtcacgggaccgacacgtagaatagagacgaactagtggcgtgcgaccactctgtcttctactcttcccgt

SEQ ID NO: 538290 - DNA, 494 bp, Homo sapiens; identical to SEQ ID NO: 534992
  misc_feature: HIJSMM301DPAFG.9.1.A01.1.454.light.4.raw

SEQ ID NO: 538291 - DNA, 488 bp, Homo sapiens
  misc_feature: HIJSMM301DQHFF.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 538292 - DNA, 474 bp, Homo sapiens
  misc_feature: HIJSMM301DVFO2.52.1.A01.1.454.light.4.raw
cgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcaccatctgtcttcatcttccgccat

SEQ ID NO: 538293 - DNA, 516 bp, Homo sapiens
  misc_feature: HIJSMM301ATFNN.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccaccctcctccg

SEQ ID NO: 538294 - DNA, 486 bp, Homo sapiens
  misc_feature: HIJSMM301CU3NA.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccggtggggctgaggatgttggcatttattactgcatgcaggctatacaccttcctgccacttttggccaggggaccaagctggagatcaggcgaacg

SEQ ID NO: 538295 - DNA, 447 bp, Homo sapiens; identical to SEQ ID NO: 535020
  misc_feature: HIJSMM301ANURH.18.9.A09.1.454.light.4.raw

SEQ ID NO: 538296 - DNA, 497 bp, Homo sapiens
  misc_feature: HIJSMM301DNPKS.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccatctgac

SEQ ID NO: 538297 - DNA, 510 bp, Homo sapiens; identical to SEQ ID NO: 535376
  misc_feature: HIJSMM301ADQA9.17.33.C11.1.454.light.4.raw

SEQ ID NO: 538298 - DNA, 478 bp, Homo sapiens
  misc_feature: HIJSMM301A9JEY.5.28.C06.1.454.light.4.raw
atcagacacgcacgaccggtgctcgatttagagctcacgtattgggtttgggggcaggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccgttcggcggagggaccaaggtggagatcgaacgaactagtgg

SEQ ID NO: 538299 - DNA, 482 bp, Homo sapiens
  misc_feature: HIJSMM301DB63H.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtcagccc

SEQ ID NO: 538300 - DNA, 444 bp, Homo sapiens; identical to SEQ ID NO: 535856
  misc_feature: HIJSMM301A3ZX4.9.9.A09.1.454.light.4.raw

SEQ ID NO: 538301 - DNA, 495 bp, Homo sapiens; identical to SEQ ID NO: 536055
  misc_feature: HIJSMM301BPW39.47.38.D05.1.454.light.4.raw

SEQ ID NO: 538302 - DNA, 444 bp, Homo sapiens; identical to SEQ ID NO: 535192
  misc_feature: HIJSMM301ER3DW.5.9.A09.1.454.light.4.raw

SEQ ID NO: 538303 - DNA, 512 bp, Homo sapiens
  misc_feature: HIJSMM301AS12P.15.59.F04.1.454.light.4.raw
tctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacggtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtccta

SEQ ID NO: 538304 - DNA, 493 bp, Homo sapiens
  misc_feature: HIJSMM301B0AKJ.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggccaggggacccaggtggagatcagacgaactgtggctgcaccatctgtcttcatcttccg

SEQ ID NO: 538305 - DNA, 494 bp, Homo sapiens; identical to SEQ ID NO: 534994
  misc_feature: HIJSMM301AV6XQ.27.78.H01.1.454.light.4.raw

SEQ ID NO: 538306 - DNA, 489 bp, Homo sapiens
  misc_feature: HIJSMM301BQPYT.47.55.E11.1.454.light.4.raw
agctcacgtacacgaccggtgctcgatttagcactcgcacgttgggtttggggagagagacccctcccctgggatcctgcagctccaggctcccgtgggtgggttagagttgggaacctatgaacattctgtaggggccactgtcttctccacggtcaccatctcttgttctggaagcagctccaatatcggaaatgataatgtatactggtaccagcaagtcccacgaacggccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtctaggtcagcccaaggccaaccccactgtcactctcgttcccaccctcctctacgtgagct

SEQ ID NO: 538307 - DNA, 484 bp, Homo sapiens; identical to SEQ ID NO: 535400
  misc_feature: HIJSMM301BM3UR.46.26.C04.1.454.light.4.raw

SEQ ID NO: 538308 - DNA, 481 bp, Homo sapiens
  misc_feature: HIJSMM301CMH77.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtgggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaactgtggctgcaccatctgtcttcta

SEQ ID NO: 538309 - DNA, 494 bp, Homo sapiens; identical to SEQ ID NO: 536444
  misc_feature: HIJSMM301C39LW.26.72.G06.1.454.light.4.raw

SEQ ID NO: 538310 - DNA, 501 bp, Homo sapiens; identical to SEQ ID NO: 536867
  misc_feature: HIJSMM301BDFCC.5.86.H09.1.454.light.4.raw

SEQ ID NO: 538311 - DNA, 494 bp, Homo sapiens; identical to SEQ ID NO: 534994
  misc_feature: HIJSMM301AHKQ6.27.78.H01.1.454.light.4.raw

SEQ ID NO: 538312 - DNA, 505 bp, Homo sapiens
  misc_feature: HIJSMM301DXPFY.48.26.C04.1.454.light.4.raw
agtatacatacacgaccggtgctcgatttagtctagcgactttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgcc

SEQ ID NO: 538313 - DNA, 507 bp, Homo sapiens
  misc_feature: HIJSMM301ALDRO.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaagtggatatcaaacgaactagtggctgcaccatctgtctt

SEQ ID NO: 538314 - DNA, 471 bp, Homo sapiens
  misc_feature: HIJSMM301CE60A.48.73.G07.1.454.light.4.raw
agtatacatacacgaccggtgctcgatttagctctacgctcagggcacgaccggtgctcgatttagagcgactagcaacacacaaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcg

SEQ ID NO: 538315 - DNA, 491 bp, Homo sapiens; identical to SEQ ID NO: 535194
  misc_feature: HIJSMM301D9C0P.26.78.H01.1.454.light.4.raw

SEQ ID NO: 538316 - DNA, 454 bp, Homo sapiens; identical to SEQ ID NO: 536392
  misc_feature: HIJSMM301CHPJ5.19.71.G05.1.454.light.4.raw

SEQ ID NO: 538317 - DNA, 492 bp, Homo sapiens
  misc_feature: HIJSMM301D9JU9.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccgggggaccaagctggaaatcaagcgaactgtggctgcaccatctgtcttcat

SEQ ID NO: 538318 - DNA, 489 bp, Homo sapiens
  misc_feature: HIJSMM301DZTNS.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctgaccgtctctgggctccaggctgaggatgaggctgattattactgcagctcatatggaggcagcgacaatttggtgttcggcggagggaccaagctgaccgtctaggtcagcccaa

SEQ ID NO: 538319 - DNA, 441 bp, Homo sapiens; identical to SEQ ID NO: 535074
  misc_feature: HIJSMM301EWLRH.11.3.A03.1.454.light.4.raw

SEQ ID NO: 538320 - DNA, 492 bp, Homo sapiens
  misc_feature: HIJSMM301EGKIY.43.25.C03.1.454.light.4.raw
tgtgagtagtcacgaccggtgctcgatttagtagtgtagatttgggtttggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttggggtttattactgcatgcaaggtacacactggcccgtcaccttcggccaagggacacgactggagattaaacgaactgtgg

SEQ ID NO: 538321 - DNA, 433 bp, Homo sapiens; identical to SEQ ID NO: 535093
  misc_feature: HIJSMM301ETIG5.18.5.A05.1.454.light.4.raw

SEQ ID NO: 538322 - DNA, 467 bp, Homo sapiens
  misc_feature: HIJSMM301BT51A.4.75.G09.1.454.light.4.raw
agcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctgatcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcactgggaccaaggtcaccgtctaggtcacg

SEQ ID NO: 538323 - DNA, 449 bp, Homo sapiens
  misc_feature: HIJSMM301AOUJ3.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactacctcatctttggtagcaacaatcggccctcaggggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 538324 - DNA, 485 bp, Homo sapiens
  misc_feature: HIJSMM301BPTFP.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggtcggagggaccagggtggaggatcagacgaa

SEQ ID NO: 538325 - DNA, 494 bp, Homo sapiens; identical to SEQ ID NO: 537607
  misc_feature: HIJSMM301A1XGA.52.10.A10.1.454.light.4.raw

SEQ ID NO: 538326 - DNA, 463 bp, Homo sapiens; identical to SEQ ID NO: 535008
  misc_feature: HIJSMM301DJ5JG.10.9.A09.1.454.light.4.raw

SEQ ID NO: 538327 - DNA, 485 bp, Homo sapiens
  misc_feature: HIJSMM301AN4GO.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccgaaactgaccgtcctaggtcagcccaaggctgccccctcggtcactctgttcccaccctcctctacgtgagct

SEQ ID NO: 538328 - DNA, 490 bp, Homo sapiens
  misc_feature: HIJSMM301AQENT.52.34.D01.1.454.light.4.raw
cgcagtacgacacgaccggtgctcgatttagatcgtctgtgttgggtttgggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctgccccccg

SEQ ID NO: 538329 - DNA, 489 bp, Homo sapiens; identical to SEQ ID NO: 535139
  misc_feature: HIJSMM301ALNN0.14.55.E11.1.454.light.4.raw

SEQ ID NO: 538330 - DNA, 493 bp, Homo sapiens; identical to SEQ ID NO: 535084
  misc_feature: HIJSMM301CW7EX.47.64.F09.1.454.light.4.raw

SEQ ID NO: 538331 - DNA, 487 bp, Homo sapiens; identical to SEQ ID NO: 535583
  misc_feature: HIJSMM301BBM0B.22.73.G07.1.454.light.4.raw

SEQ ID NO: 538332 - DNA, 498 bp, Homo sapiens
  misc_feature: HIJSMM301E22K2.13.50.E06.1.454.light.4.raw
tcacgtactacacgaccggtgctcgatttagatctactgacaacacacaagggggctgtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaatatgctcggtggttccagcagaagccaggccaggccccagtactggtgatttataaagacattgagcggccctcagggatccctgagcgattctccggctctaattcagggaccacagtcaccttgaccatcaccggggcccagattgaggatgaggctgactattattgtactctgcggctgacaaccatctggtttcggcgggggaccaagttgaccgtcgtgggtcagcccaaggctgccccctcggtcactcttcg

SEQ ID NO: 538333 - DNA, 488 bp, Homo sapiens; identical to SEQ ID NO: 535990
  misc_feature: HIJSMM301ERCET.11.28.C06.1.454.light.4.raw

SEQ ID NO: 538334 - DNA, 491 bp, Homo sapiens
  misc_feature: HIJSMM301DM905.40.11.A11.1.454.light.4.raw
tctagcgactcacgaccggtgctcgatttagctacgactgcaggggcagcaagatggtgttgcagacccaggtcttcattttctgttgctctggatctctggtgcctacggggacatcgtgatgacccagtctccagactccctggctgtgtctctgggcgagagggccaccatcaactgcaagtccagccagagtcttttatacaactccaccaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactgtggctgcaccatctgtcttcatcttcccgccat

SEQ ID NO: 538335 - DNA, 494 bp, Homo sapiens; identical to SEQ ID NO: 534992
  misc_feature: HIJSMM301CVSIP.9.1.A01.1.454.light.4.raw

SEQ ID NO: 538336 - DNA, 444 bp, Homo sapiens; identical to SEQ ID NO: 535192
  misc_feature: HIJSMM301BW321.5.9.A09.1.454.light.4.raw

SEQ ID NO: 538337 - DNA, 487 bp, Homo sapiens
  misc_feature: HIJSMM301D4G6J.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctcccgtgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatctgt

SEQ ID NO: 538338 - DNA, 489 bp, Homo sapiens
  misc_feature: HIJSMM301APSF0.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggtcggagggaccacggtggaggatcaaacgaaactgtggctgcaccaatctgtcttcta

SEQ ID NO: 538339 - DNA, 492 bp, Homo sapiens
  misc_feature: HIJSMM301AGV38.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgtttcggcggagggaccaaggtggagatcaaacgaactgtggctgcaccatctgtcttcatcttccgccat

SEQ ID NO: 538340 - DNA, 481 bp, Homo sapiens
  misc_feature: HIJSMM301B4NYN.5.34.D01.1.454.light.4.raw
atcagacacgcacgaccggtgctcgatttagatcgtctgtgttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgtaacttactattgtcaacaggctaacagtttccctccgaccttcggccaaggacacgactggagattaaacgaactgtggctgcacc

SEQ ID NO: 538341 - DNA, 494 bp, Homo sapiens
  misc_feature: HIJSMM301ADH01.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttctatcttcccg

SEQ ID NO: 538342 - DNA, 519 bp, Homo sapiens
  misc_feature: HIJSMM301CLKCS.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacgggccgggatcaaccgtgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccaccctcctccgt

SEQ ID NO: 538343 - DNA, 495 bp, Homo sapiens; identical to SEQ ID NO: 537302
  misc_feature: HIJSMM301D189F.9.1.A01.1.454.light.4.raw

SEQ ID NO: 538344 - DNA, 383 bp, Homo sapiens; identical to SEQ ID NO: 447524
  misc_feature: HIJSMM301BSNQO.41.26.C04.1.454.light.4.raw

SEQ ID NO: 538345 - DNA, 507 bp, Homo sapiens
  misc_feature: HIJSMM301DH7XW.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagcccaaggctgccccctcggtcactctgttccccg

SEQ ID NO: 538346 - DNA, 446 bp, Homo sapiens
  misc_feature: HIJSMM301DER2E.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcta

SEQ ID NO: 538347 - DNA, 501 bp, Homo sapiens
  misc_feature: HIJSMM301BCHBC.9.81.H04.1.454.light.4.raw
tgatacgtctcacgaccggtgctcgatttagtagtgtagattcgcgggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggaccacggtcaccgtcctaggtcagcccaaggccaaccccactgtcact

SEQ ID NO: 538348 - DNA, 486 bp, Homo sapiens; identical to SEQ ID NO: 535043
  misc_feature: HIJSMM301A9ZA5.46.35.D02.1.454.light.4.raw

SEQ ID NO: 538349 - DNA, 494 bp, Homo sapiens; identical to SEQ ID NO: 534992
  misc_feature: HIJSMM301BAXXH.9.1.A01.1.454.light.4.raw

SEQ ID NO: 538350 - DNA, 504 bp, Homo sapiens
  misc_feature: HIJSMM301A7ME0.17.27.C05.1.454.light.4.raw
cgtagactagcacgaccggtgctcgatttagacgcgatcgaagggtttggggaggctgtgggctcagaagcagagttctggggtgtctccaccatggcctggacccctctctggctcactctcctcactctttgcataggttctgtggtttcttctgagctgactcaggatcctgctgtgtctgtggccttgggacagaccagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactgggctcaggcggaagatgaggctgactattactgtaactccgggacagcagtgctgaccaggtggtagttcggcggagggacccaccgtgaccgtcttaggtcagcccaaggctgccccctcggtcta

SEQ ID NO: 538351 - DNA, 484 bp, Homo sapiens; identical to SEQ ID NO: 535240
  misc_feature: HIJSMM301CGB9T.47.60.F05.1.454.light.4.raw

SEQ ID NO: 538352 - DNA, 499 bp, Homo sapiens
  misc_feature: HIJSMM301CAZOS.21.81.H04.1.454.light.4.raw
tcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaacccactgtca

SEQ ID NO: 538353 - DNA, 497 bp, Homo sapiens
  misc_feature: HIJSMM301A38DK.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggaagaaattgtgttgacgcagtctccgggcaccctgtctttctctccgaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtacaaacaccttcggccaagggacacgactggagattaaaggaactgtggctgcaccatctgtcttcatcttccccg

SEQ ID NO: 538354 - DNA, 490 bp, Homo sapiens
  misc_feature: HIJSMM301CNLOL.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaacgggaccaggtggaaagtcaaacgaactagtggtcgtgcaccactcttc

SEQ ID NO: 538355 - DNA, 506 bp, Homo sapiens
  misc_feature: HIJSMM301C8WFQ.10.27.C05.1.454.light.4.raw
catagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctcttttcaaggttttcggcggagggaccaggctgaccgtcctaagtcagcccaaggctgccccctcggt

SEQ ID NO: 538356 - DNA, 492 bp, Homo sapiens; identical to SEQ ID NO: 535126
  misc_feature: HIJSMM301DKRFG.18.11.A11.1.454.light.4.raw

SEQ ID NO: 538357 - DNA, 494 bp, Homo sapiens; identical to SEQ ID NO: 534994
  misc_feature: HIJSMM301APD5R.27.78.H01.1.454.light.4.raw

SEQ ID NO: 538358 - DNA, 484 bp, Homo sapiens; identical to SEQ ID NO: 535240
  misc_feature: HIJSMM301BLPK3.47.60.F05.1.454.light.4.raw

SEQ ID NO: 538359 - DNA, 495 bp, Homo sapiens
  misc_feature: HIJSMM301EBAHW.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaacccc

SEQ ID NO: 538360 - DNA, 447 bp, Homo sapiens; identical to SEQ ID NO: 535201
  misc_feature: HIJSMM301C8K0N.18.9.A09.1.454.light.4.raw

SEQ ID NO: 538361 - DNA, 490 bp, Homo sapiens
  misc_feature: HIJSMM301BRRXH.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtcactctgttcccgccctcctctacgtgagct

SEQ ID NO: 538362 - DNA, 491 bp, Homo sapiens
  misc_feature: HIJSMM301DS4QK.48.10.A10.1.454.light.4.raw
agtatacatacacgaccggtgctcgatttagcgtcgatctcaggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacaaaattcactctcaccatcagcggcctgcagtctgatgattttgcaacttatttctgccaacagtatcatacttattctcggaccttcggccaagggaccgacggtggaaagtacaaacgaactagtggcgtgcaccatctgtcttcta

SEQ ID NO: 538363 - DNA, 442 bp, Homo sapiens
  misc_feature: HIJSMM301AWR38.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtcccgtgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 538364 - DNA, 486 bp, Homo sapiens; identical to SEQ ID NO: 535385
  misc_feature: HIJSMM301DUWZT.19.71.G05.1.454.light.4.raw

SEQ ID NO: 538365 - DNA, 504 bp, Homo sapiens
  misc_feature: HIJSMM301C2EKZ.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctggaccgaaagtggatatcaaacgaactgtggctgcaccatctgtt

SEQ ID NO: 538366 - DNA, 492 bp, Homo sapiens; identical to SEQ ID NO: 536175
  misc_feature: HIJSMM301EPTEL.19.83.H06.1.454.light.4.raw

SEQ ID NO: 538367 - DNA, 484 bp, Homo sapiens
  misc_feature: HIJSMM301BX09B.8.14.B03.1.454.light.4.raw
ctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccatacctttagtgtatattggtatcagcagaagccagggagtcctccccactatctcctgaggtataaaacagactcagataaggagcaggcctctggagtccccagccgcttctctggatccaaagatgctgcggccaatgcagggagtttgctcatctctgggctccagtttgaggatgaggctgactattattgtatgatttggtacaggagcgcttgggtgatcggcggagggaccaagctgaccgtcctaggtcagcccaagg

SEQ ID NO: 538368 - DNA, 486 bp, Homo sapiens; identical to SEQ ID NO: 535523
  misc_feature: HIJSMM301EGZ9Y.22.73.G07.1.454.light.4.raw

SEQ ID NO: 538369 - DNA, 509 bp, Homo sapiens; identical to SEQ ID NO: 537131
  misc_feature: HIJSMM301ANB56.17.33.C11.1.454.light.4.raw

SEQ ID NO: 538370 - DNA, 512 bp, Homo sapiens
  misc_feature: HIJSMM301B43V1.49.23.C01.1.454.light.4.raw
agtcgagagacacgaccggtgctcgatttagtacacgtgattagggattgggggctgtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttccccg

SEQ ID NO: 538371 - DNA, 493 bp, Homo sapiens
  misc_feature: HIJSMM301D4FNG.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccacctcctcacgcg

SEQ ID NO: 538372 - DNA, 446 bp, Homo sapiens
  misc_feature: HIJSMM301C3MOK.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatggggctgagtggttcgtatgtcttcggatctgggaccaaggtcaccgtcctaagtcagcccaaggccaaccctctgtcactctgttcccgccctcctccatactcgta

SEQ ID NO: 538373 - DNA, 479 bp, Homo sapiens; identical to SEQ ID NO: 537163
  misc_feature: HIJSMM301D0DZ0.13.73.G07.1.454.light.4.raw

SEQ ID NO: 538374 - DNA, 479 bp, Homo sapiens; identical to SEQ ID NO: 537163
  misc_feature: HIJSMM301BLM79.13.73.G07.1.454.light.4.raw

SEQ ID NO: 538375 - DNA, 498 bp, Homo sapiens
  misc_feature: HIJSMM301AY70R.10.82.H05.1.454.light.4.raw
catagtagtgcacgaccggtgctcgatttagtcgagctctctcgcgggggctctgcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatcccaggaggtgcccccaaactcctcatatatgaagatgataagcgaccgtcagggattcctgaccgattctctggctccaagtctggcacgtcggccaccctgggcatcgccggactccagactggggacgaggccgatttttactgcggaacatgggataccagcctgcatggtgtggttttcggcggagggaccaagctgaccgtcctaagtcagcccaa

SEQ ID NO: 538376 - DNA, 496 bp, Homo sapiens
  misc_feature: HIJSMM301AIWJJ.51.23.C01.1.454.light.4.raw
cgatcgtatacacgaccggtgctcgatttagtacacgtgattagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 538377 - DNA, 466 bp, Homo sapiens; identical to SEQ ID NO: 536398
  misc_feature: HIJSMM301EFOZU.3.20.B09.1.454.light.4.raw

SEQ ID NO: 538378 - DNA, 500 bp, Homo sapiens; identical to SEQ ID NO: 535310
  misc_feature: HIJSMM301CGDER.47.66.F11.1.454.light.4.raw

SEQ ID NO: 538379 - DNA, 498 bp, Homo sapiens
  misc_feature: HIJSMM301ECAHR.40.23.C01.1.454.light.4.raw
tctagcgactcacgaccggtgctcgatttagtacacgtgattagggattggggaggaactgctcagttaggacccagagggaaccatggaagccccagctcagcttctcttcctcctgctactctggctcccagataccaccggagaaattgtgttgacacagtctccagccaccctgtctttatctccaggggaaagagccatcctctcctgcagggccagtcagaatattgatacatacttagcctggtaccagcagaaacctggcctggctcccagggtcctcatccatgatgcctcccacagggccactggcatcccacacaggttcagtggcagtgggtctgggacagacttcagtctcaccatcagcagcctagagcctgaggattttgcaatttatttctgtcaacagcgtagcacctggccccgggtcaccttcggccaagggacacgactggacatgaaacgaactgtggctgcaccatctgtcttcta

SEQ ID NO: 538380 - DNA, 501 bp, Homo sapiens; identical to SEQ ID NO: 535873
  misc_feature: HIJSMM301AS7DL.17.27.C05.1.454.light.4.raw

SEQ ID NO: 538381 - DNA, 498 bp, Homo sapiens; identical to SEQ ID NO: 537020
  misc_feature: HIJSMM301BSU16.26.26.C04.1.454.light.4.raw

SEQ ID NO: 538382 - DNA, 497 bp, Homo sapiens
  misc_feature: HIJSMM301A2Z4Z.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctcgttcccaccctcctcgagtgcgtct

SEQ ID NO: 538383 - DNA, 495 bp, Homo sapiens; identical to SEQ ID NO: 538269
  misc_feature: HIJSMM301AH41F.9.1.A01.1.454.light.4.raw

SEQ ID NO: 538384 - DNA, 475 bp, Homo sapiens
  misc_feature: HIJSMM301CZQBB.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgagattttgcaacttactattgtcaacaggctgacagtctcccgctcactttcggcggagggaccaaggtggagatcaaacgaactgtggctgca

SEQ ID NO: 538385 - DNA, 515 bp, Homo sapiens
  misc_feature: HIJSMM301EA6Y7.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaagggaccgaacggtaggaaggtacaaacgaactagtggcgtgcaccactctgtcttctatcttcccgccact

SEQ ID NO: 538386 - DNA, 514 bp, Homo sapiens
  misc_feature: HIJSMM301CKZ83.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctggtcactctgttcccgccctcctcg

SEQ ID NO: 538387 - DNA, 499 bp, Homo sapiens
  misc_feature: HIJSMM301EISRZ.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgaatcgcttctctggctccaagtctggcgacacggcctccctgaccatctctgggctccaggctgaagacgaggctgattattactgcagctcatatacaggcagcagcactcaggttttcggcggaggaccgaagctgaccgtcctaggtcagcccaaggctgccccctccggta

SEQ ID NO: 538388 - DNA, 491 bp, Homo sapiens
  misc_feature: HIJSMM301C6VL7.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 538389 - DNA, 484 bp, Homo sapiens; identical to SEQ ID NO: 535400
  misc_feature: HIJSMM301C4LRT.46.26.C04.1.454.light.4.raw

SEQ ID NO: 538390 - DNA, 485 bp, Homo sapiens; identical to SEQ ID NO: 536576
  misc_feature: HIJSMM301CDFBL.46.35.D02.1.454.light.4.raw

SEQ ID NO: 538391 - DNA, 492 bp, Homo sapiens; identical to SEQ ID NO: 536010
  misc_feature: HIJSMM301B1LJ6.10.20.B09.1.454.light.4.raw

SEQ ID NO: 538392 - DNA, 511 bp, Homo sapiens
  misc_feature: HIJSMM301B7CYQ.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccgggatgaggccgactattactgtcaggtgtggaatggtgattatgattatgtcttcggaactgggaccgaaggtcaccgtcctaggtcagcccaaggccaacccacctgtcactctgttcccaccctcctccgtgtctgat

SEQ ID NO: 538393 - DNA, 463 bp, Homo sapiens; identical to SEQ ID NO: 535062
  misc_feature: HIJSMM301BMPZV.11.73.G07.1.454.light.4.raw

SEQ ID NO: 538394 - DNA, 496 bp, Homo sapiens
  misc_feature: HIJSMM301CS913.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccaccctcct

SEQ ID NO: 538395 - DNA, 491 bp, Homo sapiens
  misc_feature: HIJSMM301A1LIJ.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcgggagggaccaaaggtggaggatcaaacgaa

SEQ ID NO: 538396 - DNA, 484 bp, Homo sapiens
  misc_feature: HIJSMM301DLS1E.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccacctcctcgctacgtaga

SEQ ID NO: 538397 - DNA, 493 bp, Homo sapiens
  misc_feature: HIJSMM301D60ZT.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgagggtggaggatcagacgaactgtggctgcaccatctgtt

SEQ ID NO: 538398 - DNA, 515 bp, Homo sapiens
  misc_feature: HIJSMM301CXNWO.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccgggatgaggccgactattactgtcaggtgtggaatggtgattatgattatgtcttcggaactgggaccaaggtcaccgtcctaggtcagcccaaggccaaccccactgtcactctgttcccgccctcct

SEQ ID NO: 538399 - DNA, 498 bp, Homo sapiens; identical to SEQ ID NO: 537020
  misc_feature: HIJSMM301EA2YF.26.26.C04.1.454.light.4.raw

SEQ ID NO: 538400 - DNA, 423 bp, Homo sapiens
  misc_feature: HIJSMM301BK0X8.9.25.C03.1.454.light.4.raw
tgatacgtctcacgaccggtgctcgatttagtagtgtagatttgggtttgggaacctatgaacattctgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcggggtcgaagccggggatgaggccgactatttctgtcagctgtgggattctcatgatggtagtgggggaatcttcggcggagggaccaggctgaccgtcctaagtcagcccaaggctgccccctcggtcactctgttcccaccctcctcagacgtatca

SEQ ID NO: 538401 - DNA, 484 bp, Homo sapiens; identical to SEQ ID NO: 535400
  misc_feature: HIJSMM301ARRWJ.46.26.C04.1.454.light.4.raw

SEQ ID NO: 538402 - DNA, 485 bp, Homo sapiens; identical to SEQ ID NO: 536630
  misc_feature: HIJSMM301C3PJZ.13.56.F01.1.454.light.4.raw

SEQ ID NO: 538403 - DNA, 467 bp, Homo sapiens
  misc_feature: HIJSMM301DFBV8.41.48.E04.1.454.light.4.raw
tctatactatcacgaccggtgctcgatttagagagcgtcacagagagaaggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcct

SEQ ID NO: 538404 - DNA, 515 bp, Homo sapiens
  misc_feature: HIJSMM301C8175.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccgcctcctcacg

SEQ ID NO: 538405 - DNA, 463 bp, Homo sapiens; identical to SEQ ID NO: 535062
  misc_feature: HIJSMM301AH99P.11.73.G07.1.454.light.4.raw

SEQ ID NO: 538406 - DNA, 495 bp, Homo sapiens; identical to SEQ ID NO: 535821
  misc_feature: HIJSMM301CE40D.3.31.C09.1.454.light.4.raw

SEQ ID NO: 538407 - DNA, 486 bp, Homo sapiens; identical to SEQ ID NO: 535385
  misc_feature: HIJSMM301CSVRD.19.71.G05.1.454.light.4.raw

SEQ ID NO: 538408 - DNA, 415 bp, Homo sapiens; identical to SEQ ID NO: 536118
  misc_feature: HIJSMM301EOR3X.18.78.H01.1.454.light.4.raw

SEQ ID NO: 538409 - DNA, 460 bp, Homo sapiens
  misc_feature: HIJSMM301BYNNU.11.86.H09.1.454.light.4.raw
  modified_base (442)..(442): a, c, t, g, unknown or other
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccnccctcctcgtatctctcg

SEQ ID NO: 538410 - DNA, 514 bp, Homo sapiens
  misc_feature: HIJSMM301BA7AC.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctctacttcggtcggacgggaccgaacggacggacgagtacacgaacggaacctacgtgggtcgtcgcgaccaactcttcgttcttccta

SEQ ID NO: 538411 - DNA, 493 bp, Homo sapiens
  misc_feature: HIJSMM301CSS4P.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactgacatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttcccg

SEQ ID NO: 538412 - DNA, 365 bp, Homo sapiens
  misc_feature: HIJSMM301CLE0R.3.11.A11.1.454.light.4.raw
agacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacccactgccactgaacctgtctgggatgccaggggccctgctggatgcaccaaagatgaggagactggagcctgaagattttgcagtgtattactgtcaggtctatggttactcacctcggttcagctttggccaggggaccaaggtggagatcaaacgaactgtggctgcaccatctgtcttcatcttcccgccatctgagagtgcgtct

SEQ ID NO: 538413 - DNA, 485 bp, Homo sapiens; identical to SEQ ID NO: 535963
  misc_feature: HIJSMM301A7JN5.15.28.C06.1.454.light.4.raw

SEQ ID NO: 538414 - DNA, 490 bp, Homo sapiens
  misc_feature: HIJSMM301C90H5.49.67.G01.1.454.light.4.raw
agtcgagagacacgaccggtgctcgatttagagtatacatattggtttggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 538415 - DNA, 498 bp, Homo sapiens; identical to SEQ ID NO: 535295
  misc_feature: HIJSMM301EPD4M.15.25.C03.1.454.light.4.raw

SEQ ID NO: 538416 - DNA, 507 bp, Homo sapiens
  misc_feature: HIJSMM301AWF24.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgttgacttggcacaacaacgcctggatcttcggacctgggaccacggtcaccgtcctaggtcagcccaaggccaacccccactgtcactctgttcccccg

SEQ ID NO: 538417 - DNA, 448 bp, Homo sapiens
  misc_feature: HIJSMM301C0W1C.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactaggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 538418 - DNA, 503 bp, Homo sapiens
  misc_feature: HIJSMM301CGFUM.43.38.D05.1.454.light.4.raw
tgtgagtagtcacgaccggtgctcgatttagtatctgatagttgggtttgggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaaggaccagggtggaaagtcaaacgaactagtggctgcaccatctgtcttcatcttccccg

SEQ ID NO: 538419 - DNA, 510 bp, Homo sapiens
  misc_feature: HIJSMM301D7DPZ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaattcggggtccctgaccgattcagtggcagcgggtctgggacagatttcactctcaccatcagcagcctgcaggctgaagatgtggcagtttattactgtcaacagttttctcggggcgttcggccgaagggaccgaaggtaggaaagtacaaacgaactagtggctgcaccatctgtcttctatcttccccg

SEQ ID NO: 538420 - DNA, 492 bp, Homo sapiens
  misc_feature: HIJSMM301DB29U.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctctacttcgtcggagggaccgaagacggagatcagacgaactgtggctgcaccactctcgtcttcta

SEQ ID NO: 538421 - DNA, 495 bp, Homo sapiens
  misc_feature: HIJSMM301AH8E2.21.27.C05.1.454.light.4.raw
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacggaccgaaggtggaaatcaaacgaactgtggctgcaccatctgtctt

SEQ ID NO: 538422 - DNA, 505 bp, Homo sapiens
  misc_feature: HIJSMM301CQYYQ.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtca

SEQ ID NO: 538423 - DNA, 504 bp, Homo sapiens
  misc_feature: HIJSMM301AI3MN.48.67.G01.1.454.light.4.raw
agtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 538424 - DNA, 383 bp, Homo sapiens; identical to SEQ ID NO: 447524
  misc_feature: HIJSMM301BARON.41.26.C04.1.454.light.4.raw

SEQ ID NO: 538425 - DNA, 447 bp, Homo sapiens; identical to SEQ ID NO: 535201
  misc_feature: HIJSMM301CQRVP.18.9.A09.1.454.light.4.raw

SEQ ID NO: 538426 - DNA, 405 bp, Homo sapiens
  misc_feature: HIJSMM301BO6U6.4.35.D02.1.454.light.4.raw
agcactgtagcacgaccggtgctcgatttagcacacgatagttgggtttggggtttcatgagtgcagggagacggccaggattacttgtgggggagacaacattggagataaaagtagtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgtcactctgttcccaccctcctcctacagtgct

SEQ ID NO: 538427 - DNA, 447 bp, Homo sapiens; identical to SEQ ID NO: 535201
  misc_feature: HIJSMM301DVSQD.18.9.A09.1.454.light.4.raw

SEQ ID NO: 538428 - DNA, 520 bp, Homo sapiens
  misc_feature: HIJSMM301A0XNM.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgt

SEQ ID NO: 538429 - DNA, 494 bp, Homo sapiens
  misc_feature: HIJSMM301ALZOT.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccacgggacacgactggagattaaaggaactgtggctgcaccatctgtcttcatcttccccg

SEQ ID NO: 538430 - DNA, 489 bp, Homo sapiens
  misc_feature: HIJSMM301AP7BH.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaattttattactgtatgcaaggtatagagcttcctccgacgttcggccaagggaccaaggtggaactacaaacgaa

SEQ ID NO: 538431 - DNA, 501 bp, Homo sapiens
  misc_feature: HIJSMM301B9362.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttggtgttcggcggagggaccaaactgaccgtcctaggtcagcccaa

SEQ ID NO: 538432 - DNA, 510 bp, Homo sapiens; identical to SEQ ID NO: 535855
  misc_feature: HIJSMM301COJA5.17.33.C11.1.454.light.4.raw

SEQ ID NO: 538433 - DNA, 521 bp, Homo sapiens
  misc_feature: HIJSMM301EBW4D.16.88.H11.1.454.light.4.raw
tgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgacccttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctcgacg

SEQ ID NO: 538434 - DNA, 495 bp, Homo sapiens
  misc_feature: HIJSMM301AVWEZ.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactctcg

SEQ ID NO: 538435 - DNA, 488 bp, Homo sapiens; identical to SEQ ID NO: 536554
  misc_feature: HIJSMM301BPLFA.26.37.D04.1.454.light.4.raw

SEQ ID NO: 538436 - DNA, 447 bp, Homo sapiens; identical to SEQ ID NO: 535201
  misc_feature: HIJSMM301AMMSJ.18.9.A09.1.454.light.4.raw

SEQ ID NO: 538437 - DNA, 447 bp, Homo sapiens; identical to SEQ ID NO: 535201
  misc_feature: HIJSMM301DAAQT.18.9.A09.1.454.light.4.raw

SEQ ID NO: 538438 - DNA, 352 bp, Homo sapiens; identical to SEQ ID NO: 535995
  misc_feature: HIJSMM301A4G8F.4.67.G01.1.454.light.4.raw

SEQ ID NO: 538439 - DNA, 446 bp, Homo sapiens
  misc_feature: HIJSMM301A0BCX.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcga

SEQ ID NO: 538440 - DNA, 500 bp, Homo sapiens
  misc_feature: HIJSMM301BQTSQ.53.5.A05.1.454.light.4.raw
cgcgtatacacacgaccggtgctcgatttagatagatagacagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggcccctctattggtaatgtataaagacaatgagaggccctcagggatccctgagcgattctctggctccaactcagggacaacagtcacgttgaccatcggtggagtccaggcagaagacgaggctgactattactgtcaatcagcaggcagcagtggaactgtgcttttcggcggagggaccaagctgaccgtcctacgtcagcccaaggctgccccctccggtcactctgttccccg

SEQ ID NO: 538441 - DNA, 354 bp, Homo sapiens; identical to SEQ ID NO: 535026
  misc_feature: HIJSMM301DSVZQ.19.22.B11.1.454.light.4.raw

SEQ ID NO: 538442 - DNA, 486 bp, Homo sapiens; identical to SEQ ID NO: 535043
  misc_feature: HIJSMM301EPZPK.46.35.D02.1.454.light.4.raw

SEQ ID NO: 538443 - DNA, 486 bp, Homo sapiens
  misc_feature: HIJSMM301BQ0AN.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttcccctcacttcgtcggaggaccgaaggtggagatcaagacgaactgtggctgcaccat

SEQ ID NO: 538444 - DNA, 494 bp, Homo sapiens; identical to SEQ ID NO: 534994
  misc_feature: HIJSMM301DO303.27.78.H01.1.454.light.4.raw

SEQ ID NO: 538445 - DNA, 494 bp, Homo sapiens; identical to SEQ ID NO: 534992
  misc_feature: HIJSMM301CM90X.9.1.A01.1.454.light.4.raw

SEQ ID NO: 538446 - DNA, 496 bp, Homo sapiens; identical to SEQ ID NO: 535109
  misc_feature: HIJSMM301CJOOF.16.78.H01.1.454.light.4.raw

SEQ ID NO: 538447 - DNA, 492 bp, Homo sapiens
  misc_feature: HIJSMM301APD5F.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggtcggagggaccgaacggcggagatcagacgaactgtggctgcaccatctgtcttcta

SEQ ID NO: 538448 - DNA, 510 bp, Homo sapiens; identical to SEQ ID NO: 537801
  misc_feature: HIJSMM301DKW8D.5.60.F05.1.454.light.4.raw

SEQ ID NO: 538449 - DNA, 494 bp, Homo sapiens; identical to SEQ ID NO: 534994
  misc_feature: HIJSMM301AODJ0.27.78.H01.1.454.light.4.raw

SEQ ID NO: 538450 - DNA, 486 bp, Homo sapiens; identical to SEQ ID NO: 535458
  misc_feature: HIJSMM301C3CVB.7.75.G09.1.454.light.4.raw

SEQ ID NO: 538451 - DNA, 485 bp, Homo sapiens; identical to SEQ ID NO: 535985
  misc_feature: HIJSMM301D0YLN.15.1.A01.1.454.light.4.raw

SEQ ID NO: 538452 - DNA, 518 bp, Homo sapiens
  misc_feature: HIJSMM301D0Z3L.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccgaacggaccgaacggtaggaaagtacaacgacgaaaccgtagtggcgtgcaccactctgtcttctatcttcccgt

SEQ ID NO: 538453 - DNA, 516 bp, Homo sapiens
  misc_feature: HIJSMM301CRNA5.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccgacggaccgaacggtaggaaagtacaagacgaacctagtggcgtgcgaccaactctgtcttcacttcttcccgt

SEQ ID NO: 538454 - DNA, 486 bp, Homo sapiens; identical to SEQ ID NO: 535917
  misc_feature: HIJSMM301AU9Z9.3.10.A10.1.454.light.4.raw

SEQ ID NO: 538455 - DNA, 461 bp, Homo sapiens
  misc_feature: HIJSMM301CMS37.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggaggggaccaggctgaccgtcctaggtcagcccaaggctgccccctcggtcactctgttcccgccctcctcacgcgtatgt

SEQ ID NO: 538456 - DNA, 492 bp, Homo sapiens; identical to SEQ ID NO: 536360
  misc_feature: HIJSMM301A57ON.11.81.H04.1.454.light.4.raw

SEQ ID NO: 538457 - DNA, 492 bp, Homo sapiens; identical to SEQ ID NO: 536010
  misc_feature: HIJSMM301AYBUB.10.20.B09.1.454.light.4.raw

SEQ ID NO: 538458 - DNA, 486 bp, Homo sapiens; identical to SEQ ID NO: 536261
  misc_feature: HIJSMM301BJFUL.26.55.E11.1.454.light.4.raw

SEQ ID NO: 538459 - DNA, 508 bp, Homo sapiens; identical to SEQ ID NO: 536388
  misc_feature: HIJSMM301C3W0Q.11.57.F02.1.454.light.4.raw

SEQ ID NO: 538460 - DNA, 496 bp, Homo sapiens
  misc_feature: HIJSMM301EBNO9.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctccacttcggtcggagggaccgaacggacggaggatcagacgaactgtggcgtgcaccactctgtcttcta

SEQ ID NO: 538461 - DNA, 501 bp, Homo sapiens
  misc_feature: HIJSMM301CJXXZ.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctgtt

SEQ ID NO: 538462 - DNA, 478 bp, Homo sapiens
  misc_feature: HIJSMM301CAJ3G.48.51.E07.1.454.light.4.raw
agtatacatacacgaccggtgctcgatttagcatactctacaacacacaaaggggcaggagtcagtctcagtcaggacacagcatggacatgagggtccccgctcagctcctggggctcctgctactctggctccgaggtgccagatgtgacatccagatgacccagtctccatcctccctgtctgcatctgtgggagacagagtcaccatcacttgccgggcaagtcagagcattagcagctatttaaattggtatcagcagaaaccagggaaagcccctaagctcctgatctatggtgcatccattttgcaaagtgggatcccatcagggttcagtggcagtgggtctgggacagatttcactctcaccatcagcagtttgcaacctgaagattttgcaacttactactgtcaacagagttacagtgacccgtacaattttggccaggggaccaagctggagatcaaacgaactgt

SEQ ID NO: 538463 - DNA, 486 bp, Homo sapiens; identical to SEQ ID NO: 535523
  misc_feature: HIJSMM301A4SO4.22.73.G07.1.454.light.4.raw

SEQ ID NO: 538464 - DNA, 497 bp, Homo sapiens
  misc_feature: HIJSMM301EZRNO.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaacgaactgtggctgcaccatctgtcttcat

SEQ ID NO: 538465 - DNA, 502 bp, Homo sapiens
  misc_feature: HIJSMM301DNNVO.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcacgtcctaggtcagcccaaggccaaccccatgtca

SEQ ID NO: 538466 - DNA, 496 bp, Homo sapiens
  misc_feature: HIJSMM301BMEE6.10.33.C11.1.454.light.4.raw
catagtagtgcacgaccggtgctcgatttagagtgagctcgttgggtttggggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaactgtggctgcaccatctgtcttcatt

SEQ ID NO: 538467 - DNA, 494 bp, Homo sapiens; identical to SEQ ID NO: 535276
  misc_feature: HIJSMM301AXT28.16.6.A06.1.454.light.4.raw

SEQ ID NO: 538468 - DNA, 495 bp, Homo sapiens; identical to SEQ ID NO: 535007
  misc_feature: HIJSMM301ADGBI.22.5.A05.1.454.light.4.raw

SEQ ID NO: 538469 - DNA, 489 bp, Homo sapiens
  misc_feature: HIJSMM301CLXFR.43.73.G07.1.454.light.4.raw
tgtgagtagtcacgaccggtgctcgatttagctctacgctcagggcacgaccggtgctcgatttagagagagtgtgttgggtttgggggcttgtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtcctaggtcagcccaaggctgccccctcggtcactctgttcccaccctcctcactactcaca

SEQ ID NO: 538470 - DNA, 479 bp, Homo sapiens; identical to SEQ ID NO: 535118
  misc_feature: HIJSMM301D1P6T.13.59.F04.1.454.light.4.raw

SEQ ID NO: 538471 - DNA, 503 bp, Homo sapiens
  misc_feature: HIJSMM301A28YY.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctccccctacctaattacgttcgaggacggaactaggtacaactctaacactaccgacgttggcgtctcgacccaact

SEQ ID NO: 538472 - DNA, 467 bp, Homo sapiens; identical to SEQ ID NO: 535997
  misc_feature: HIJSMM301CUJP8.5.36.D03.1.454.light.4.raw

SEQ ID NO: 538473 - DNA, 471 bp, Homo sapiens
  misc_feature: HIJSMM301APZ1L.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtgggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaactgtgg

SEQ ID NO: 538474 - DNA, 479 bp, Homo sapiens; identical to SEQ ID NO: 535586
  misc_feature: HIJSMM301DF3NP.13.34.D01.1.454.light.4.raw

SEQ ID NO: 538475 - DNA, 487 bp, Homo sapiens; identical to SEQ ID NO: 536006
  misc_feature: HIJSMM301AHMAG.4.64.F09.1.454.light.4.raw

SEQ ID NO: 538476 - DNA, 454 bp, Homo sapiens; identical to SEQ ID NO: 535005
  misc_feature: HIJSMM301DCRUB.19.86.H09.1.454.light.4.raw

SEQ ID NO: 538477 - DNA, 478 bp, Homo sapiens
  misc_feature: HIJSMM301AE9FA.7.81.H04.1.454.light.4.raw
  modified_base (460)..(460): a, c, t, g, unknown or other
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaactacacttcgtcctcggtcgtagaagtgcatatnaagaaggaactagtaggt

SEQ ID NO: 538478 - DNA, 461 bp, Homo sapiens
  misc_feature: HIJSMM301A1GJ8.51.23.C01.1.454.light.4.raw
cgatcgtatacacgaccggtgctcgatttagtacacgtgattagggattgggggaggaactgctcagttaggacccagagggaaccatggaagccccagctcagcttctcttcctcctgctactctggctcccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagatcaaacgaactgtggctgcaccatctgtcttcatcttcccgccatctgatcgtagcact

SEQ ID NO: 538479 - DNA, 503 bp, Homo sapiens
  misc_feature: HIJSMM301CHH72.15.86.H09.1.454.light.4.raw
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccaccctcctcg

SEQ ID NO: 538480 - DNA, 492 bp, Homo sapiens
  misc_feature: HIJSMM301A9CZG.14.30.C08.1.454.light.4.raw
cgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgacacccttttaaattggtatcagcagaagccagggaaagcccctaaacttctgatctatgatgcaaccaatttacaagatgggatcccatcaaggttcagtggcggtggatctggggcggatttcactctcaccatcagcagtctgcaacctgaagattttgcgacttactggtgtcaacagggttatcataacccgtacacttttggccaggggaccaagctggacatcatacgaactgtggctgcaccatctgt

SEQ ID NO: 538481 - DNA, 493 bp, Homo sapiens; identical to SEQ ID NO: 535084
  misc_feature: HIJSMM301ARV9D.47.64.F09.1.454.light.4.raw

SEQ ID NO: 538482 - DNA, 485 bp, Homo sapiens
  misc_feature: HIJSMM301APIH8.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccctacttcgccgtcggaaccaagtggatatacaaacgaactgtggctgcaccatctgtt

SEQ ID NO: 538483 - DNA, 485 bp, Homo sapiens; identical to SEQ ID NO: 535880
  misc_feature: HIJSMM301CEOMY.7.75.G09.1.454.light.4.raw

SEQ ID NO: 538484 - DNA, 487 bp, Homo sapiens
  misc_feature: HIJSMM301EG3V8.14.55.E11.1.454.light.4.raw
  modified_base (157)..(157): a, c, t, g, unknown or other
  modified_base (426)..(426): a, c, t, g, unknown or other
  modified_base (481)..(481): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccangtctccatcctcctgtctgcatctgtaggagacagagtcaccatcacttgccgggcaagtcagagcaattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtaccccncctctacgttcggcggaggacgaggacgagatacagacgaacgtgtggctgcacntctctt

SEQ ID NO: 538485 - DNA, 447 bp, Homo sapiens; identical to SEQ ID NO: 535201
  misc_feature: HIJSMM301CPBO6.18.9.A09.1.454.light.4.raw

SEQ ID NO: 538486 - DNA, 516 bp, Homo sapiens
  misc_feature: HIJSMM301D226A.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttgaagcagccgatccagcctgcggagcctgtggggcaggtcagcccaaggctgccccctcggtcactctgtcccgccctcctccacg

SEQ ID NO: 538487 - DNA, 489 bp, Homo sapiens
  misc_feature: HIJSMM301DICUV.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggaggaccaaggtggaggtcaaacgaactgtggctgcaccatctgtcttcat

SEQ ID NO: 538488 - DNA, 510 bp, Homo sapiens; identical to SEQ ID NO: 535855
  misc_feature: HIJSMM301A94OJ.17.33.C11.1.454.light.4.raw

SEQ ID NO: 538489 - DNA, 498 bp, Homo sapiens
  misc_feature: HIJSMM301DCKQV.52.65.F10.1.454.light.4.raw
cgcagtacgacacgaccggtgctcgatttagctacgctctaagggggcaggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgtcgggcgagtcaggttgttagcgcctggttagcctggtatcagcagaaaccagggaaagcccctaaagtcctggtctatgctacatccaatttgcaaagtggcgtcccctcaaggttccgcggcagtggatctgggacaaatttcactctcaccatcagcagcctgcagcctgaagattttgcgacttactattgtcaacaggggtacagttttccgtacacctttggccaggggactaagctggacatcaaacgactgtggctgcaccatctgtcttcatcttccccg

SEQ ID NO: 538490 - DNA, 492 bp, Homo sapiens
  misc_feature: HIJSMM301AN6L6.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccacgggaccgaccggtggagtgtctaagacgaacctagtggcgtgcaccact

SEQ ID NO: 538491 - DNA, 463 bp, Homo sapiens
  misc_feature: HIJSMM301BFSRK.15.11.A11.1.454.light.4.raw
tctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctccctgggagcctcggtcaagctcacctgcactctgagcagtgggcacaccagctacgccatcgcatggcatcagcagcagccagagaagggccctcgctacttgatgaagcttaacactgatggcagccacaggtaagggggacgggatccctgatcgcttctcaggctccagctctggggctgagcgctacctcaccatctccagcctccagtctgaggatgaggctgactattactgtcagacctggggcactggcaatagtt

SEQ ID NO: 538492 - DNA, 508 bp, Homo sapiens; identical to SEQ ID NO: 536388
  misc_feature: HIJSMM301BOPO7.11.57.F02.1.454.light.4.raw

SEQ ID NO: 538493 - DNA, 495 bp, Homo sapiens
  misc_feature: HIJSMM301B3J4M.3.31.C09.1.454.light.4.raw
  modified_base (201)..(201): a, c, t, g, unknown or other
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgaactgtggctgcaccatctgtctt

SEQ ID NO: 538494 - DNA, 483 bp, Homo sapiens; identical to SEQ ID NO: 535317
  misc_feature: HIJSMM301AKIH4.4.1.A01.1.454.light.4.raw

SEQ ID NO: 538495 - DNA, 448 bp, Homo sapiens
  misc_feature: HIJSMM301A5YBG.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatcttggtagcaacaatcggccctcaggggtcccgtcgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctcactactcgta

SEQ ID NO: 538496 - DNA, 505 bp, Homo sapiens
  misc_feature: HIJSMM301AG6HH.48.71.G05.1.454.light.4.raw
agtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttcccg

SEQ ID NO: 538497 - DNA, 508 bp, Homo sapiens
  misc_feature: HIJSMM301A7TOP.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccgaaggtggaagtcaagcgaactgtggctgcaccatctgtcttcatcttcccgcc

SEQ ID NO: 538498 - DNA, 489 bp, Homo sapiens
  misc_feature: HIJSMM301CR0ZO.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 538499 - DNA, 483 bp, Homo sapiens; identical to SEQ ID NO: 535413
  misc_feature: HIJSMM301EBZ1P.26.78.H01.1.454.light.4.raw

SEQ ID NO: 538500 - DNA, 480 bp, Homo sapiens
  misc_feature: HIJSMM301DJ7ZO.26.23.C01.1.454.light.4.raw
  modified_base (458)..(458): a, c, t, g, unknown or other
  modified_base (460)..(460): a, c, t, g, unknown or other
  modified_base (467)..(467): a, c, t, g, unknown or other
  modified_base (470)..(470): a, c, t, g, unknown or other
  modified_base (476)..(476): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgcaacaatatgatatttattctccagcgttcggcgagggaccaaggtgagtnangacatgngtncgcacnctgt

SEQ ID NO: 538501 - DNA, 515 bp, Homo sapiens
  misc_feature: HIJSMM301AK316.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgtcgtccaggaccgaacggtaggaaggtacgaaacgaactagtggcgtgcaccactctgtcttctatcttcccgtcccact

SEQ ID NO: 538502 - DNA, 446 bp, Homo sapiens; identical to SEQ ID NO: 536034
  misc_feature: HIJSMM301B8RMI.18.9.A09.1.454.light.4.raw

SEQ ID NO: 538503 - DNA, 493 bp, Homo sapiens
  misc_feature: HIJSMM301CNQ48.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcacatctgtcttcatcttccccg

SEQ ID NO: 538504 - DNA, 508 bp, Homo sapiens; identical to SEQ ID NO: 536062
  misc_feature: HIJSMM301C7KWO.11.57.F02.1.454.light.4.raw

SEQ ID NO: 538505 - DNA, 502 bp, Homo sapiens; identical to SEQ ID NO: 537816
  misc_feature: HIJSMM301AZBZM.19.78.H01.1.454.light.4.raw

SEQ ID NO: 538506 - DNA, 483 bp, Homo sapiens
  misc_feature: HIJSMM301BH05R.3.88.H11.1.454.light.4.raw
agacgcactccacgaccggtgctcgatttagcgacagcgagaacacacaaaggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttcccttaatcttcggccaagggacacgactggagattaaacgaactgtggctgcacca

SEQ ID NO: 538507 - DNA, 490 bp, Homo sapiens
  misc_feature: HIJSMM301DRN2X.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttgggttattactgcatgcaagctctacaaactccctcaacgttcggcggagggaccaaggtggagatcaaacgaactgtggctgcaccatctgtcttca

SEQ ID NO: 538508 - DNA, 490 bp, Homo sapiens
  misc_feature: HIJSMM301B2QG5.10.79.H02.1.454.light.4.raw
catagtagtgcacgaccggtgctcgatttagtgtcacacgaaggggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctggacttttggccagggaccaagctggagatcaacgaactgtgctgcaccatctgtctt

SEQ ID NO: 538509 - DNA, 489 bp, Homo sapiens; identical to SEQ ID NO: 535139
  misc_feature: HIJSMM301BXEST.14.55.E11.1.454.light.4.raw

SEQ ID NO: 538510 - DNA, 444 bp, Homo sapiens; identical to SEQ ID NO: 535594
  misc_feature: HIJSMM301CG492.9.9.A09.1.454.light.4.raw

SEQ ID NO: 538511 - DNA, 444 bp, Homo sapiens
  misc_feature: HIJSMM301BJ0C4.5.9.A09.1.454.light.4.raw
  modified_base (426)..(426): a, c, t, g, unknown or other
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccnccctcctccgtgtctgat

SEQ ID NO: 538512 - DNA, 472 bp, Homo sapiens
  misc_feature: HIJSMM301BW6E3.51.11.A11.1.454.light.4.raw
cgatcgtatacacgaccggtgctcgatttagctacgactgcaggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggaggatcaaacgaaactgtggctgcacc

SEQ ID NO: 538513 - DNA, 487 bp, Homo sapiens; identical to SEQ ID NO: 536206
  misc_feature: HIJSMM301B6I35.47.38.D05.1.454.light.4.raw

SEQ ID NO: 538514 - DNA, 485 bp, Homo sapiens; identical to SEQ ID NO: 535606
  misc_feature: HIJSMM301CKO1J.47.46.E02.1.454.light.4.raw

SEQ ID NO: 538515 - DNA, 514 bp, Homo sapiens
  misc_feature: HIJSMM301B5P5X.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtccttggtcagcccaaggctgccccctcggtcactctgttcccgccct

SEQ ID NO: 538516 - DNA, 493 bp, Homo sapiens
  misc_feature: HIJSMM301CK4E8.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtatgggacagagttcactctcaccatcagcagcctgcagtctgaagattttgcagtttttactgtcagcagtatagtaactggcctccgtacacttttggccaggggaccaagctagaaatcaaacgaactgtggctgcaccatctgtcttca

SEQ ID NO: 538517 - DNA, 494 bp, Homo sapiens
  misc_feature: HIJSMM301CQ5P0.41.18.B07.1.454.light.4.raw
tctatactatcacgaccggtgctcgatttagtcgctgcgtaagggggtgtgggtccaggaggcagaactctgggtgtctcaccatggcctggatccctctacttctcccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcggtgttcggcggggacgaagctgaccgtcctaggtcagcccaaggctcgcccctcggtcactctcg

SEQ ID NO: 538518 - DNA, 511 bp, Homo sapiens
  misc_feature: HIJSMM301DRTWY.11.75.G09.1.454.light.4.raw
  modified_base (473)..(473): a, c, t, g, unknown or other
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagacttccggttttcggcggagggactaagctgaccgtcctaagtcngacccaaggctcgccccctccggtcactctgttcccta

SEQ ID NO: 538519 - DNA, 501 bp, Homo sapiens; identical to SEQ ID NO: 535746
  misc_feature: HIJSMM301A61AE.18.11.A11.1.454.light.4.raw

SEQ ID NO: 538520 - DNA, 502 bp, Homo sapiens
  misc_feature: HIJSMM301C96U2.48.28.C06.1.454.light.4.raw
agtatacatacacgaccggtgctcgatttagagctcacgtattgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgcctaccagggccactggcgtcccggccaggttcagtgccagtgggtctgggacagacttcactctcaccatcagcagcctagagcccgaagattttgcggtttattactgtcagcagcgtgccaactggcctctcacgttcggcggaggaccaaggtggacatcaaacgaactgtggctgcaccatctgtcttcatcttccccg

SEQ ID NO: 538521 - DNA, 504 bp, Homo sapiens
  misc_feature: HIJSMM301DXX3R.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatacaaacgaactagtggctgcaccatctgtcttcatcttccccg

SEQ ID NO: 538522 - DNA, 495 bp, Homo sapiens
  misc_feature: HIJSMM301BG108.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggtccaggggaccaagctggagatcaaacgaactgtggctgcaccatctgtctt

SEQ ID NO: 538523 - DNA, 503 bp, Homo sapiens; identical to SEQ ID NO: 536579
  misc_feature: HIJSMM301EV194.27.78.H01.1.454.light.4.raw

SEQ ID NO: 538524 - DNA, 491 bp, Homo sapiens
  misc_feature: HIJSMM301BVFE2.19.25.C03.1.454.light.4.raw
tactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcagactttcggcggagggaccgaaggtggagatcaaacgaactgtggctgcaccatctgt

SEQ ID NO: 538525 - DNA, 497 bp, Homo sapiens; identical to SEQ ID NO: 536376
  misc_feature: HIJSMM301CFIA3.22.9.A09.1.454.light.4.raw

SEQ ID NO: 538526 - DNA, 491 bp, Homo sapiens
  misc_feature: HIJSMM301D6PI0.48.57.F02.1.454.light.4.raw
agtatacatacacgaccggtgctcgatttagctcgatatagttgggtttggggtgggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgtttggcagagggaccaagctgaccgtcctaggtcagcccaagg

SEQ ID NO: 538527 - DNA, 478 bp, Homo sapiens
  misc_feature: HIJSMM301BCDZM.13.34.D01.1.454.light.4.raw
tcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacgactggagattaaggaa

SEQ ID NO: 538528 - DNA, 514 bp, Homo sapiens
  misc_feature: HIJSMM301AJQJD.49.11.A11.1.454.light.4.raw
agtcgagagacacgaccggtgctcgatttagctacgactgcagggctgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcg

SEQ ID NO: 538529 - DNA, 494 bp, Homo sapiens; identical to SEQ ID NO: 534992
  misc_feature: HIJSMM301C70LD.9.1.A01.1.454.light.4.raw

SEQ ID NO: 538530 - DNA, 495 bp, Homo sapiens; identical to SEQ ID NO: 535007
  misc_feature: HIJSMM301C2911.22.5.A05.1.454.light.4.raw

SEQ ID NO: 538531 - DNA, 486 bp, Homo sapiens; identical to SEQ ID NO: 535043
  misc_feature: HIJSMM301EY33W.46.35.D02.1.454.light.4.raw

SEQ ID NO: 538532 - DNA, 488 bp, Homo sapiens
  misc_feature: HIJSMM301EHQP2.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaacctggccaggctcccaggctcctcatctatgctgcatcccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactgtggctgcaccatctgtt

SEQ ID NO: 538533 - DNA, 485 bp, Homo sapiens
  misc_feature: HIJSMM301A6LQG.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccgccctcctctacgtgagct

SEQ ID NO: 538534 - DNA, 512 bp, Homo sapiens
  misc_feature: HIJSMM301D5HIJ.15.86.H09.1.454.light.4.raw
tctacgtagccacgaccggtgctcgatttagtgctatagacttgggtttgggggacttccctggtctccttctacctactgcccttcatttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccaccctcctcgctacgtaga

SEQ ID NO: 538535 - DNA, 478 bp, Homo sapiens
  misc_feature: HIJSMM301CJ0R5.18.76.G10.1.454.light.4.raw
  modified_base (422)..(422): a, c, t, g, unknown or other
tacgagtatgcacgaccggtgctcgatttagtcactcatacaggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatagatttgtntcctccgacgtgtccactttcggtggggaccggaacggtaggagatacaacaacgt

SEQ ID NO: 538536 - DNA, 505 bp, Homo sapiens
  misc_feature: HIJSMM301BP6ZJ.19.78.H01.1.454.light.4.raw
tactctcgtgcacgaccggtgctcgatttagtgtgagtagtttggggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaagggtcaccgtctaggtcagcccaaggccaaccccactgtca

SEQ ID NO: 538537 - DNA, 490 bp, Homo sapiens
  misc_feature: HIJSMM301CN1BP.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactcctgaccatcagcgggacccaggctattgatgaggctgtctacttctgtcaggcgtgggacaacagcgtggtgttcggcggagggaccagtctgaccgtcttaggtcagcccaaggctgccccctcggtcact

SEQ ID NO: 538538 - DNA, 494 bp, Homo sapiens
  misc_feature: HIJSMM301DFNHM.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggaccaagggacacgactggagattaaacgaactgtggctgcacatctgtctt

SEQ ID NO: 538539 - DNA, 494 bp, Homo sapiens
  misc_feature: HIJSMM301CR25Z.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccagggtggaggatcaaacgaactgtggctgcaccatctgtcttcta

SEQ ID NO: 538540 - DNA, 494 bp, Homo sapiens; identical to SEQ ID NO: 534994
  misc_feature: HIJSMM301A1UVE.27.78.H01.1.454.light.4.raw

SEQ ID NO: 538541 - DNA, 514 bp, Homo sapiens
  misc_feature: HIJSMM301AYRVA.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctgccccctcggtcactctgttccccg

SEQ ID NO: 538542 - DNA, 488 bp, Homo sapiens
  misc_feature: HIJSMM301BBYKA.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtatttgcagtctattactgtcagcagtatggtcacgtcccaagtaacttttggccgagggaccaagcgtggagatcaaacgaactgtggctgcaccat

SEQ ID NO: 538543 - DNA, 484 bp, Homo sapiens
  misc_feature: HIJSMM301D2MX3.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcctgctcactttcggcggagggaccaaggtggagatcaacgaac

SEQ ID NO: 538544 - DNA, 489 bp, Homo sapiens; identical to SEQ ID NO: 535139
  misc_feature: HIJSMM301BN6SC.14.55.E11.1.454.light.4.raw

SEQ ID NO: 538545 - DNA, 484 bp, Homo sapiens
  misc_feature: HIJSMM301CXLNK.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttattctgccaacagtatcatacttattctcggaccttcggccaaggaccagggtggaaatacaaacgaactagtggctgcaccatctgtctt

SEQ ID NO: 538546 - DNA, 487 bp, Homo sapiens; identical to SEQ ID NO: 535508
  misc_feature: HIJSMM301AZR57.13.87.H10.1.454.light.4.raw

SEQ ID NO: 538547 - DNA, 497 bp, Homo sapiens
  misc_feature: HIJSMM301B6OES.14.55.E11.1.454.light.4.raw
  modified_base (455)..(455): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcgtcggagggacgaagacggaggancagacgaactagtggtcgtcgcaccaactctcgttcttctta

SEQ ID NO: 538548 - DNA, 473 bp, Homo sapiens; identical to SEQ ID NO: 536941
  misc_feature: HIJSMM301C68Z9.3.38.D05.1.454.light.4.raw

SEQ ID NO: 538549 - DNA, 495 bp, Homo sapiens
  misc_feature: HIJSMM301BA9YL.12.87.H10.1.454.light.4.raw
atacgacgtacacgaccggtgctcgatttagcagtactgcgttgggtttgggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaacccactgt

SEQ ID NO: 538550 - DNA, 504 bp, Homo sapiens; identical to SEQ ID NO: 535561
  misc_feature: HIJSMM301DRZOS.4.57.F02.1.454.light.4.raw

SEQ ID NO: 538551 - DNA, 467 bp, Homo sapiens
  misc_feature: HIJSMM301BCXC4.48.23.C01.1.454.light.4.raw
agtatacatacacgaccggtgctcgatttagtacacgtgattagggattgggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 538552 - DNA, 508 bp, Homo sapiens; identical to SEQ ID NO: 536388
  misc_feature: HIJSMM301BD3XW.11.57.F02.1.454.light.4.raw

SEQ ID NO: 538553 - DNA, 495 bp, Homo sapiens; identical to SEQ ID NO: 535731
  misc_feature: HIJSMM301AHHNL.16.78.H01.1.454.light.4.raw

SEQ ID NO: 538554 - DNA, 484 bp, Homo sapiens
  misc_feature: HIJSMM301AMI1F.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggccaagctggagatcaaacgaactgtggctgcaccat

SEQ ID NO: 538555 - DNA, 510 bp, Homo sapiens
  misc_feature: HIJSMM301BQDPN.47.85.H08.1.454.light.4.raw
agctcacgtacacgaccggtgctcgatttagtatcactcagtcgcggggggggtctcaggaggcagcgctctcaggacatctccaccatggcctgggctctgctggctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgtt

SEQ ID NO: 538556 - DNA, 485 bp, Homo sapiens
  misc_feature: HIJSMM301BDNS7.49.81.H04.1.454.light.4.raw
agtcgagagacacgaccggtgctcgatttagtagtgtagattcgcggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggaggatcaaacgaactgtggctgcaccatctgtt

SEQ ID NO: 538557 - DNA, 487 bp, Homo sapiens
  misc_feature: HIJSMM301DBIQS.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccaggggaccaaggctggagatcacaggaactgtggctgcacc

SEQ ID NO: 538558 - DNA, 496 bp, Homo sapiens
  misc_feature: HIJSMM301BE6MI.43.29.C07.1.454.light.4.raw
tgtgagtagtcacgaccggtgctcgatttagagtgctacgaagggaaaggggagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccagggtggagatcaaacgaactgtggctgcaccatctgtcttcatcttccccg

SEQ ID NO: 538559 - DNA, 485 bp, Homo sapiens
  misc_feature: HIJSMM301C421Z.49.3.A03.1.454.light.4.raw
agtcgagagacacgaccggtgctcgatttagagagcgtcacagggggaggaactgctcagttaggacccagacggaaccatggaagccccagcgcagcttctcttcctcctgctactctggctcccagataccactggagaaatagtgatgacgcagtctccagccactttgtctgtgtctccaggggagagagccactctctcctgcaggaccagtcagagtgttaataacaagttagcctggtaccagcagagacctggccaggctcccaggctcctcatctatgatgtgtctaccagggccactggtatcccagccaggttcagtggcagtgggtctggggcgagttcactctcaccatcagcagcctgcagtctgaagatttgcagtttattactgtcagcactctaatgactggcccctgtacacttttggcccggggaccaaggtggagatcaaacgaactgtggctgcaccatctgtt

SEQ ID NO: 538560 - DNA, 499 bp, Homo sapiens
  misc_feature: HIJSMM301COI4F.53.81.H04.1.454.light.4.raw
cgcgtatacacacgaccggtgctcgatttagtagtgtagattcgcggggagcttcagctgtggtagagaagacaggattcaggacaatctccagcatggtcggcttccctctcctcctcaccctcctcactcactgtgcagggtcctgggcccagtctgtgctgactcagccaccctcagcgtctgggacccccgggcagagggtcaccatctcctgttctggaagcaggtccaacatcggaagtgattttgtattctggtaccagctgctcccaggagcgggccccaaactcctcatttacaggaatgatcagcggccctcaggggtccctgaccgattctctggctccaagtctggcacctcagcctccctggccatcagtggcctccggtccgacgatgaggctgattattattgtgcagcatgggatgacagcctgagtggtgtggtattcggcggagggaccaagctgaccgtcctaggtcagcccaaggctcg

SEQ ID NO: 538561 - DNA, 460 bp, Homo sapiens; identical to SEQ ID NO: 536053
  misc_feature: HIJSMM301A9KXP.22.28.C06.1.454.light.4.raw

SEQ ID NO: 538562 - DNA, 490 bp, Homo sapiens
  misc_feature: HIJSMM301EN488.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcgtcggacggacgacgaggcgatcagacgactagtggcgtcgcaccactctcgtcttcta

SEQ ID NO: 538563 - DNA, 505 bp, Homo sapiens; identical to SEQ ID NO: 536233
  misc_feature: HIJSMM301BAQ19.48.25.C03.1.454.light.4.raw

SEQ ID NO: 538564 - DNA, 478 bp, Homo sapiens
  misc_feature: HIJSMM301COBYM.5.70.G04.1.454.light.4.raw
atcagacacgcacgaccggtgctcgatttagtgtagtgtgaagggaaaggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggcggagggaccaaggtggagatcaaacgaactgtggctgca

SEQ ID NO: 538565 - DNA, 494 bp, Homo sapiens; identical to SEQ ID NO: 534994
  misc_feature: HIJSMM301BOI8X.27.78.H01.1.454.light.4.raw

SEQ ID NO: 538566 - DNA, 509 bp, Homo sapiens; identical to SEQ ID NO: 536047
  misc_feature: HIJSMM301DPFU5.17.33.C11.1.454.light.4.raw

SEQ ID NO: 538567 - DNA, 445 bp, Homo sapiens
  misc_feature: HIJSMM301AKDDE.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccaccctcctcccgtgtctgat

SEQ ID NO: 538568 - DNA, 486 bp, Homo sapiens
  misc_feature: HIJSMM301DNG09.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccagggaccaagctggagatcaaacgaa

SEQ ID NO: 538569 - DNA, 493 bp, Homo sapiens
  misc_feature: HIJSMM301BNO5M.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccgaaagtggatttcagacgaactgtggctgcaccatctgtcttcta

SEQ ID NO: 538570 - DNA, 520 bp, Homo sapiens
  misc_feature: HIJSMM301CXP5K.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 538571 - DNA, 503 bp, Homo sapiens
  misc_feature: HIJSMM301BMR6L.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaaatagaggtcaaacgaaactgtggctgcaccatctgtcttcat

SEQ ID NO: 538572 - DNA, 481 bp, Homo sapiens
  misc_feature: HIJSMM301CUPTP.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcgccaaggaccgaagtggaatcaaacgaactgtggctgcaccta

SEQ ID NO: 538573 - DNA, 422 bp, Homo sapiens; identical to SEQ ID NO: 447881
  misc_feature: HIJSMM301A1L3E.9.34.D01.1.454.light.4.raw

SEQ ID NO: 538574 - DNA, 495 bp, Homo sapiens; identical to SEQ ID NO: 535486
  misc_feature: HIJSMM301A5F17.26.72.G06.1.454.light.4.raw

SEQ ID NO: 538575 - DNA, 494 bp, Homo sapiens; identical to SEQ ID NO: 534994
  misc_feature: HIJSMM301AM98L.27.78.H01.1.454.light.4.raw

SEQ ID NO: 538576 - DNA, 520 bp, Homo sapiens; identical to SEQ ID NO: 535686
  misc_feature: HIJSMM301D4ACP.41.19.B08.1.454.light.4.raw

SEQ ID NO: 538577 - DNA, 520 bp, Homo sapiens
  misc_feature: HIJSMM301DC0PI.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaagctgccccctcggtcactctgttcccgccct

SEQ ID NO: 538578 - DNA, 494 bp, Homo sapiens; identical to SEQ ID NO: 536974
  misc_feature: HIJSMM301BIWEH.16.86.H09.1.454.light.4.raw

SEQ ID NO: 538579 - DNA, 463 bp, Homo sapiens; identical to SEQ ID NO: 535062
  misc_feature: HIJSMM301CKQX6.11.73.G07.1.454.light.4.raw

SEQ ID NO: 538580 - DNA, 500 bp, Homo sapiens
  misc_feature: HIJSMM301CTI3D.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtggttcggcgggggaccgaagctgaccgtcctaggtcagccaaggctgcccctcggtcactc

SEQ ID NO: 538581 - DNA, 500 bp, Homo sapiens
  misc_feature: HIJSMM301CCANA.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtccctcgaggttcagtggcagtggatctgggacacatttcaccctcaccatcaatagcctggaagctgaagatgctgcaacttattactgtcatcagagtactatttacctcaagtgatcaccttcgcgacggacgacacgtgagagttaaacg

SEQ ID NO: 538582 - DNA, 517 bp, Homo sapiens
  misc_feature: HIJSMM301BV7M3.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaagggaccgaacggtaggaaggtacaaacgaactagtggctgcaccatctgtcttctactcttcccgcccact

SEQ ID NO: 538583 - DNA, 503 bp, Homo sapiens
  misc_feature: HIJSMM301DI1T4.15.59.F04.1.454.light.4.raw
tctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggt

SEQ ID NO: 538584 - DNA, 444 bp, Homo sapiens; identical to SEQ ID NO: 535027
  misc_feature: HIJSMM301BZ3KV.8.73.G07.1.454.light.4.raw

SEQ ID NO: 538585 - DNA, 419 bp, Homo sapiens
  misc_feature: HIJSMM301EOMX5.40.57.F02.1.454.light.4.raw
tctagcgactcacgaccggtgctcgatttagctcgatatagttgggtttgggacctttgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaaggctgccccctcggtcactctgttcccaccctcctcagtcgctaga

SEQ ID NO: 538586 - DNA, 486 bp, Homo sapiens; identical to SEQ ID NO: 535290
  misc_feature: HIJSMM301A8TSD.3.12.B01.1.454.light.4.raw

SEQ ID NO: 538587 - DNA, 474 bp, Homo sapiens
  misc_feature: HIJSMM301C20PG.48.28.C06.1.454.light.4.raw
agtatacatacacgaccggtgctcgatttagagctcacgtattgggtttggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagccc

SEQ ID NO: 538588 - DNA, 495 bp, Homo sapiens
  misc_feature: HIJSMM301A6M0Z.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaagtcaaacgaactgtggctgcaccatctgtcttcat

SEQ ID NO: 538589 - DNA, 465 bp, Homo sapiens
  misc_feature: HIJSMM301A8A85.12.39.D06.1.454.light.4.raw
atacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgctcccttttgtattggtttctgcagagaggcaggccagtctccacaactcctgatctatgaagttgccacccggctctctggagtgccagatatgttcagtggctgcgggtcaggcacagatctcacactgaaaaacagccgggtggagagtgaccatgttggaacttatta

SEQ ID NO: 538590 - DNA, 441 bp, Homo sapiens; identical to SEQ ID NO: 534971
  misc_feature: HIJSMM301CWSU1.11.3.A03.1.454.light.4.raw

SEQ ID NO: 538591 - DNA, 441 bp, Homo sapiens; identical to SEQ ID NO: 534971
  misc_feature: HIJSMM301AER6Z.11.3.A03.1.454.light.4.raw

SEQ ID NO: 538592 - DNA, 481 bp, Homo sapiens; identical to SEQ ID NO: 535993
  misc_feature: HIJSMM301D939M.21.25.C03.1.454.light.4.raw

SEQ ID NO: 538593 - DNA, 478 bp, Homo sapiens; identical to SEQ ID NO: 535129
  misc_feature: HIJSMM301ATZIJ.11.11.A11.1.454.light.4.raw

SEQ ID NO: 538594 - DNA, 494 bp, Homo sapiens; identical to SEQ ID NO: 535276
  misc_feature: HIJSMM301D3ML4.16.6.A06.1.454.light.4.raw

SEQ ID NO: 538595 - DNA, 479 bp, Homo sapiens
  misc_feature: HIJSMM301AWJS6.48.26.C04.1.454.light.4.raw
agtatacatacacgaccggtgctcgatttagtctagcgactttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaa

SEQ ID NO: 538596 - DNA, 496 bp, Homo sapiens; identical to SEQ ID NO: 535109
  misc_feature: HIJSMM301AR9Q7.16.78.H01.1.454.light.4.raw

SEQ ID NO: 538597 - DNA, 485 bp, Homo sapiens
  misc_feature: HIJSMM301CCMU3.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaaggaccgaacggtggaaatacaaacgaactgtggctgcacca

SEQ ID NO: 538598 - DNA, 479 bp, Homo sapiens
  misc_feature: HIJSMM301EBIKX.51.27.C05.1.454.light.4.raw
cgatcgtatacacgaccggtgctcgatttagacgcgatcgaagggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcacccaatttggaaagtggggtcccatcaaggttcagtggcagtggatctgggacagatttcactctcaccatcagcagtgtgcgacctgaagattttgcaacttactactgtcaacagagttacagtacccctcagctcactttcggcggagggaccaaggtggagatcaaacgaactgtggctgcacc

SEQ ID NO: 538599 - DNA, 454 bp, Homo sapiens; identical to SEQ ID NO: 536347
  misc_feature: HIJSMM301CEN9A.19.86.H09.1.454.light.4.raw

SEQ ID NO: 538600 - DNA, 490 bp, Homo sapiens
  misc_feature: HIJSMM301COXRJ.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctccattttcggtcggagggaccgaaggtggcagatcaaacgaaactgtggctgcaa

SEQ ID NO: 538601 - DNA, 494 bp, Homo sapiens
  misc_feature: HIJSMM301A09UR.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggaggaccgaaggacggagatcagacgaactagtggcgtgcgaccactctgtcttcta

SEQ ID NO: 538602 - DNA, 485 bp, Homo sapiens
  misc_feature: HIJSMM301DCUIO.52.23.C01.1.454.light.4.raw
cgcagtacgacacgaccggtgctcgatttagtacacgtgattagggattggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggcggaggaccaaggtggagatcagacgaactgtggctgcaccatctgtctt

SEQ ID NO: 538603 - DNA, 495 bp, Homo sapiens; identical to SEQ ID NO: 535596
  misc_feature: HIJSMM301DJI80.10.79.H02.1.454.light.4.raw

SEQ ID NO: 538604 - DNA, 508 bp, Homo sapiens
  misc_feature: HIJSMM301DUXT2.10.71.G05.1.454.light.4.raw
catagtagtgcacgaccggtgctcgatttagtgtcgtcgcaagagagaggggggacgtgctcagttaggacccagagggaaccatggaagccccacgctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcatcttccccg

SEQ ID NO: 538605 - DNA, 500 bp, Homo sapiens
  misc_feature: HIJSMM301CIKA5.11.31.C09.1.454.light.4.raw
cgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtcccgaccgattcagtggcagcgggtctgggacagatttcactctcacaatcagcagcctgcagactgaagatgtgggcgtttattattgtcaacaatattctcttgttccgtttaatttcggcggagggaccaaggtggagatcaaacgaactgtggctgcaccatctgtcttcatcttcccgccat

SEQ ID NO: 538606 - DNA, 494 bp, Homo sapiens; identical to SEQ ID NO: 535276
  misc_feature: HIJSMM301A6GYF.16.6.A06.1.454.light.4.raw

SEQ ID NO: 538607 - DNA, 444 bp, Homo sapiens; identical to SEQ ID NO: 534993
  misc_feature: HIJSMM301DEIOH.5.9.A09.1.454.light.4.raw

SEQ ID NO: 538608 - DNA, 490 bp, Homo sapiens; identical to SEQ ID NO: 538273
  misc_feature: HIJSMM301C0YUW.16.73.G07.1.454.light.4.raw

SEQ ID NO: 538609 - DNA, 462 bp, Homo sapiens
  misc_feature: HIJSMM301AWOQ3.49.8.A08.1.454.light.4.raw
agtcgagagacacgaccggtgctcgatttagcatactctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaacaggggtcccatcaaggttcagtggaagtggctctgggacagattttactttcaccatcagcagactgcagcctgaagatattgcaacatattactgtcaacagtatgatagtctcccgctcactttcggtggagggaccaaggtaggagatcaaacgaa

SEQ ID NO: 538610 - DNA, 493 bp, Homo sapiens
  misc_feature: HIJSMM301CXN13.7.59.F04.1.454.light.4.raw
  modified_base (420)..(420): a, c, t, g, unknown or other
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataanagttatccgtggacttcggccaagggaccagggtggaaatcaaacgaactgtggctgcaccatctgtctcatt

SEQ ID NO: 538611 - DNA, 476 bp, Homo sapiens
  misc_feature: HIJSMM301DNE8E.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgaagtgcatatgaagagaactgtggctgca

SEQ ID NO: 538612 - DNA, 488 bp, Homo sapiens
  misc_feature: HIJSMM301A2DDB.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggcgtgggacagcagcactgaggtgttcggcggagggaccaagctgaccgtcctacgtcagcccaaggctgccccccg

SEQ ID NO: 538613 - DNA, 497 bp, Homo sapiens; identical to SEQ ID NO: 537300
  misc_feature: HIJSMM301A9YX2.9.53.E09.1.454.light.4.raw

SEQ ID NO: 538614 - DNA, 510 bp, Homo sapiens
  misc_feature: HIJSMM301BSW5X.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttccca

SEQ ID NO: 538615 - DNA, 477 bp, Homo sapiens
  misc_feature: HIJSMM301AZHHK.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactacccctctcactttcggcggggggaccgaacggtaggaggatacaacgaaa

SEQ ID NO: 538616 - DNA, 516 bp, Homo sapiens
  misc_feature: HIJSMM301AGKXA.48.59.F04.1.454.light.4.raw
agtatacatacacgaccggtgctcgatttagtacacacacttagggattggggagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagccggcccccagactctacatctataataattatcgccggccctcaggggtccctgaccgacgtctctgcctccaagtctggcacctcagcctccctggccatcagtggcctccggtctgaaggaggagggtgattattactgtgcagcggtgggatgacagcctgaatgcgttgggtggttcggcggagggaccaagttgaccgtcctaggtcaacccagctcgccccctcggtcactctcgttccct

SEQ ID NO: 538617 - DNA, 483 bp, Homo sapiens
  misc_feature: HIJSMM301BVUJV.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctcccccactttcggccctcgggaccaaagtggatatcaaacgaactgtggctgcaccat

SEQ ID NO: 538618 - DNA, 489 bp, Homo sapiens
  misc_feature: HIJSMM301EKBN9.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggcgtgaggatgttggcatttattactgcatgcaggctatacaccttcctgccacttttggccaggggaccaagctggagatcaggcgaacg

SEQ ID NO: 538619 - DNA, 496 bp, Homo sapiens
  misc_feature: HIJSMM301BEH61.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgaactgtggctgcaccatctgtcttc

SEQ ID NO: 538620 - DNA, 447 bp, Homo sapiens; identical to SEQ ID NO: 535020
  misc_feature: HIJSMM301CY9EQ.18.9.A09.1.454.light.4.raw

SEQ ID NO: 538621 - DNA, 497 bp, Homo sapiens
  misc_feature: HIJSMM301AY8B9.51.78.H01.1.454.light.4.raw
cgatcgtatacacgaccggtgctcgatttagtgtgagtagtttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccacctgtcact

SEQ ID NO: 538622 - DNA, 441 bp, Homo sapiens; identical to SEQ ID NO: 535074
  misc_feature: HIJSMM301ALV6B.11.3.A03.1.454.light.4.raw

SEQ ID NO: 538623 - DNA, 485 bp, Homo sapiens
  misc_feature: HIJSMM301B522P.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtcctggtcagcccaaggctgcccccg

SEQ ID NO: 538624 - DNA, 509 bp, Homo sapiens; identical to SEQ ID NO: 536047
  misc_feature: HIJSMM301BKPYI.17.33.C11.1.454.light.4.raw

SEQ ID NO: 538625 - DNA, 496 bp, Homo sapiens
  misc_feature: HIJSMM301DFLA1.2.49.E05.1.454.light.4.raw
acgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcct

SEQ ID NO: 538626 - DNA, 514 bp, Homo sapiens
  misc_feature: HIJSMM301AXV3O.8.34.D01.1.454.light.4.raw
ctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccgactttcggtccctcgggaccaaacgtagggatatcaaacgaaactgtggctgcaccatctgtcttcta

SEQ ID NO: 538627 - DNA, 484 bp, Homo sapiens
  misc_feature: HIJSMM301CH2JM.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttccctttaatcttcggccaagggacacgactggagattaacgaactgtggctgcacca

SEQ ID NO: 538628 - DNA, 488 bp, Homo sapiens
  misc_feature: HIJSMM301BASG9.40.8.A08.1.454.light.4.raw
tctagcgactcacgaccggtgctcgatttagcatactctacagggggctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagactgttttatacagctccaacaatgagaactacgttgcttggtaccagcagaaaccaggacagcctcctaagttgctcatttactgggcatctacccgggcatccggggtccctgaccgattcagtggcagcgggtctgggacagatttcactctcaccatcaacaacctgcaggctgaagatgtggcagtttattactgtcaacaatattatactactccgctcactttcggcggaggcaccaaggtggagatcagacgaactgtggctgca

SEQ ID NO: 538629 - DNA, 503 bp, Homo sapiens
  misc_feature: HIJSMM301AS7TU.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagattttactctcaccatcagcagcctgcaggctgaagatgtggcagtttattactgtcaacagttttctcgggcgttcgccaaggaccgaaggtaggaaatacaaacgaactgtggctgcaccatctgtcttcatcttcccgt

SEQ ID NO: 538630 - DNA, 502 bp, Homo sapiens
  misc_feature: HIJSMM301C6I2N.15.57.F02.1.454.light.4.raw
tctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccacctcctcgctaccgtaga

SEQ ID NO: 538631 - DNA, 493 bp, Homo sapiens; identical to SEQ ID NO: 535047
  misc_feature: HIJSMM301C5XDT.16.53.E09.1.454.light.4.raw

SEQ ID NO: 538632 - DNA, 495 bp, Homo sapiens; identical to SEQ ID NO: 535596
  misc_feature: HIJSMM301C1IZA.10.79.H02.1.454.light.4.raw

SEQ ID NO: 538633 - DNA, 516 bp, Homo sapiens
  misc_feature: HIJSMM301EPWV1.15.86.H09.1.454.light.4.raw
  modified_base (400)..(400): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtgggagagagccanacaattgatggccaaagacggttgggtgttcggcggagggaccaagctgaccgtcctaggtcagccccaaggctgccccctggtcactctgttccccaccctcctcgctacgtaga

SEQ ID NO: 538634 - DNA, 385 bp, Homo sapiens
  misc_feature: HIJSMM301CF0NO.12.41.D08.1.454.light.4.raw
atacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcaccatcaccagactgcagtctgatgattttgcactttattactgtcagcactataataattggcctccggagtacacctttggccaggggaccaagctggagatcaaacgaactgtggctgcaccatctgtcttcatcttcccgccatctgatacgtcgtat

SEQ ID NO: 538635 - DNA, 513 bp, Homo sapiens; identical to SEQ ID NO: 535719
  misc_feature: HIJSMM301A32S6.17.33.C11.1.454.light.4.raw

SEQ ID NO: 538636 - DNA, 486 bp, Homo sapiens
  misc_feature: HIJSMM301DLQC3.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagttttccctccgacctttcggccaacggacgacgactggagattaaacgaactagtggctg

SEQ ID NO: 538637 - DNA, 461 bp, Homo sapiens
  misc_feature: HIJSMM301CMFNN.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccgccctcctccgtatctctcg

SEQ ID NO: 538638 - DNA, 483 bp, Homo sapiens; identical to SEQ ID NO: 535480
  misc_feature: HIJSMM301DP874.46.26.C04.1.454.light.4.raw

SEQ ID NO: 538639 - DNA, 494 bp, Homo sapiens
  misc_feature: HIJSMM301A6VII.43.55.E11.1.454.light.4.raw
tgtgagtagtcacgaccggtgctcgatttagcactcgcacgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgaccgtcctaggtcagcccaaggctgccccctcggtcactctgttcccaccctcctcacta

SEQ ID NO: 538640 - DNA, 496 bp, Homo sapiens; identical to SEQ ID NO: 536802
  misc_feature: HIJSMM301A24KG.5.24.C02.1.454.light.4.raw

SEQ ID NO: 538641 - DNA, 464 bp, Homo sapiens; identical to SEQ ID NO: 536640
  misc_feature: HIJSMM301BZID8.26.78.H01.1.454.light.4.raw

SEQ ID NO: 538642 - DNA, 485 bp, Homo sapiens; identical to SEQ ID NO: 535363
  misc_feature: HIJSMM301A67NL.17.26.C04.1.454.light.4.raw

SEQ ID NO: 538643 - DNA, 499 bp, Homo sapiens
  misc_feature: HIJSMM301BP8FZ.48.1.A01.1.454.light.4.raw
agtatacatacacgaccggtgctcgatttagacgtctcatcagggggcaggagtcagacccagtcaggactcagcatggacatgagggtccccgctcagctcctggggctcctgctgctctggttcccaggttccagatgcgacatccagataacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcatcttccccg

SEQ ID NO: 538644 - DNA, 492 bp, Homo sapiens
  misc_feature: HIJSMM301CGLRX.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggaggatcagacgaactgtggctgcaccatctgtt

SEQ ID NO: 538645 - DNA, 497 bp, Homo sapiens; identical to SEQ ID NO: 536376
  misc_feature: HIJSMM301CS251.22.9.A09.1.454.light.4.raw

SEQ ID NO: 538646 - DNA, 496 bp, Homo sapiens; identical to SEQ ID NO: 535541
  misc_feature: HIJSMM301A42D1.3.33.C11.1.454.light.4.raw

SEQ ID NO: 538647 - DNA, 503 bp, Homo sapiens
  misc_feature: HIJSMM301ALL1X.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaactcatcatttatgatgccactaagcggccctcaggggtttcgtaatcgcttctctggctccaagtctggcaacacggcctccctgacaatctctgggcgtccaggctgaggacgaggctgattactactgctgctcatatgcaggtcgtatctcttatgtcttcggaactgggaccaaggtcaccgtcctaggtcagcccaaggccaacccactgtca

SEQ ID NO: 538648 - DNA, 449 bp, Homo sapiens
  misc_feature: HIJSMM301A2S9B.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctccaggggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 538649 - DNA, 484 bp, Homo sapiens; identical to SEQ ID NO: 536162
  misc_feature: HIJSMM301BECOY.13.59.F04.1.454.light.4.raw

SEQ ID NO: 538650 - DNA, 501 bp, Homo sapiens; identical to SEQ ID NO: 536867
  misc_feature: HIJSMM301D1TP6.5.86.H09.1.454.light.4.raw

SEQ ID NO: 538651 - DNA, 495 bp, Homo sapiens
  misc_feature: HIJSMM301CW69K.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtcttcta

SEQ ID NO: 538652 - DNA, 496 bp, Homo sapiens; identical to SEQ ID NO: 535109
  misc_feature: HIJSMM301ADKVB.16.78.H01.1.454.light.4.raw

SEQ ID NO: 538653 - DNA, 505 bp, Homo sapiens; identical to SEQ ID NO: 535987
  misc_feature: HIJSMM301BPGM6.18.37.D04.1.454.light.4.raw

SEQ ID NO: 538654 - DNA, 501 bp, Homo sapiens; identical to SEQ ID NO: 537793
  misc_feature: HIJSMM301EF16Z.15.37.D04.1.454.light.4.raw

SEQ ID NO: 538655 - DNA, 493 bp, Homo sapiens; identical to SEQ ID NO: 535745
  misc_feature: HIJSMM301CQMCV.47.78.H01.1.454.light.4.raw

SEQ ID NO: 538656 - DNA, 508 bp, Homo sapiens
  misc_feature: HIJSMM301DLMSJ.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctcgtcctacgtcagcccaaggccaacccactgtcactctgttcccta

SEQ ID NO: 538657 - DNA, 484 bp, Homo sapiens
  misc_feature: HIJSMM301BCNPB.49.87.H10.1.454.light.4.raw
agtcgagagacacgaccggtgctcgatttagcagtactgcgttgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggtccaggggaccaagctggagatcaagcgaactgtggctgcaccat

SEQ ID NO: 538658 - DNA, 496 bp, Homo sapiens
  misc_feature: HIJSMM301A7MDR.14.55.E11.1.454.light.4.raw
  modified_base (435)..(435): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacgatcccaggatgacccagtcgtccagtcctacccgtgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccccctnacctttcggcggagggaccaaggcggagatcagacgaactgtggctgcaccatctgtcttc

SEQ ID NO: 538659 - DNA, 504 bp, Homo sapiens; identical to SEQ ID NO: 535128
  misc_feature: HIJSMM301BSZXP.19.85.H08.1.454.light.4.raw

SEQ ID NO: 538660 - DNA, 386 bp, Homo sapiens
  misc_feature: HIJSMM301CHVY8.49.35.D02.1.454.light.4.raw
agtcgagagacacgaccggtgctcgatttagcacacgatagttgggtttggggtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagatttttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 538661 - DNA, 485 bp, Homo sapiens; identical to SEQ ID NO: 535880
  misc_feature: HIJSMM301BWYOQ.7.75.G09.1.454.light.4.raw

SEQ ID NO: 538662 - DNA, 514 bp, Homo sapiens
  misc_feature: HIJSMM301AO9BC.13.6.A06.1.454.light.4.raw
  modified_base (471)..(471): a, c, t, g, unknown or other
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggcgtgaggagtgttggggtttagttacttgcatgcaagctctacaacctctgcggacttcgtcccgtcggaccgaactagggggganaagtcaacgaaactacgtggtcgtgcgaccactactcgtcttt

SEQ ID NO: 538663 - DNA, 502 bp, Homo sapiens
  misc_feature: HIJSMM301AKOHD.48.36.D03.1.454.light.4.raw
agtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaaccccactgt

SEQ ID NO: 538664 - DNA, 497 bp, Homo sapiens; identical to SEQ ID NO: 536376
  misc_feature: HIJSMM301C6YXW.22.9.A09.1.454.light.4.raw

SEQ ID NO: 538665 - DNA, 474 bp, Homo sapiens
  misc_feature: HIJSMM301CXS5J.3.82.H05.1.454.light.4.raw
agacgcactccacgaccggtgctcgatttagtcgagctctctcgcggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagatttgcaacttactattgtcaacaggctgacagtctcccgctcactttcggcggagggaccaaggtggagatcaaacgaactagtgg

SEQ ID NO: 538666 - DNA, 505 bp, Homo sapiens; identical to SEQ ID NO: 535503
  misc_feature: HIJSMM301CERGE.8.28.C06.1.454.light.4.raw

SEQ ID NO: 538667 - DNA, 512 bp, Homo sapiens
  misc_feature: HIJSMM301A8ZO8.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcaggagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgtttccgccctcctca

SEQ ID NO: 538668 - DNA, 492 bp, Homo sapiens; identical to SEQ ID NO: 535426
  misc_feature: HIJSMM301AK5CN.47.78.H01.1.454.light.4.raw

SEQ ID NO: 538669 - DNA, 502 bp, Homo sapiens
  misc_feature: HIJSMM301CD8P7.4.71.G05.1.454.light.4.raw
agcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagcccaaggctgccccctggtcactctgtt

SEQ ID NO: 538670 - DNA, 500 bp, Homo sapiens
  misc_feature: HIJSMM301AT2OO.3.31.C09.1.454.light.4.raw
agacgcactccacgaccggtgctcgatttagacgtctcatcaaggaaggaagggggaggaacgtgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaaggctcccaggctcctcatctatgatgcatccaacagggccacgtggcatcccagccaggttcagtggcagtgggtctgggacagacttcactctcaccatcagcagcctagagcctgaagattttgctagtttattactgtcagcagcgtagctaactggacctctcactttcggcggaggaccaaggtggagatcaaacgaactgtggctgcaccatctgtctt

SEQ ID NO: 538671 - DNA, 504 bp, Homo sapiens
  misc_feature: HIJSMM301CMHJK.5.58.F03.1.454.light.4.raw
atcagacacgcacgaccggtgctcgatttagtctgatcgagaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccactgtcact

SEQ ID NO: 538672 - DNA, 485 bp, Homo sapiens; identical to SEQ ID NO: 536307
  misc_feature: HIJSMM301DW7GY.46.35.D02.1.454.light.4.raw

SEQ ID NO: 538673 - DNA, 495 bp, Homo sapiens
  misc_feature: HIJSMM301C149X.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 538674 - DNA, 486 bp, Homo sapiens
  misc_feature: HIJSMM301C5C8Y.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggttattactgcatgcaagttctacaaacttcctacacttttggccaggggaccaagctggagatcaaacgaa

SEQ ID NO: 538675 - DNA, 491 bp, Homo sapiens; identical to SEQ ID NO: 535294
  misc_feature: HIJSMM301CV1CL.16.68.G02.1.454.light.4.raw

SEQ ID NO: 538676 - DNA, 506 bp, Homo sapiens
  misc_feature: HIJSMM301DPWDJ.5.58.F03.1.454.light.4.raw
  modified_base (444)..(444): a, c, t, g, unknown or other
  modified_base (494)..(494): a, c, t, g, unknown or other
atcagacacgcacgaccggtgctcgatttagtctgatcgagaagggaaaggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgattttactgctgctcatatgcaggtgatcactactttntgtcggacgtggacaagtcacctccgtaggtcagcccgaagccaaccccntgtcactcttcc

SEQ ID NO: 538677 - DNA, 460 bp, Homo sapiens; identical to SEQ ID NO: 536053
  misc_feature: HIJSMM301BU6VJ.22.28.C06.1.454.light.4.raw

SEQ ID NO: 538678 - DNA, 441 bp, Homo sapiens
  misc_feature: HIJSMM301B3IB6.11.3.A03.1.454.light.4.raw
cgagagataccacgaccggtgctcgatttagagagcgtcacagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcactctgttcccgccctcctcgtatctctcg

SEQ ID NO: 538679 - DNA, 479 bp, Homo sapiens; identical to SEQ ID NO: 535665
  misc_feature: HIJSMM301DH0AW.12.10.A10.1.454.light.4.raw

SEQ ID NO: 538680 - DNA, 503 bp, Homo sapiens; identical to SEQ ID NO: 535044
  misc_feature: HIJSMM301AGGNL.19.78.H01.1.454.light.4.raw

SEQ ID NO: 538681 - DNA, 504 bp, Homo sapiens
  misc_feature: HIJSMM301BUZ4C.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaacgaactgtggctgcaccatctgtctt

SEQ ID NO: 538682 - DNA, 490 bp, Homo sapiens; identical to SEQ ID NO: 535234
  misc_feature: HIJSMM301EIP2Q.17.21.B10.1.454.light.4.raw

SEQ ID NO: 538683 - DNA, 487 bp, Homo sapiens; identical to SEQ ID NO: 535583
  misc_feature: HIJSMM301AW6KB.22.73.G07.1.454.light.4.raw

SEQ ID NO: 538684 - DNA, 454 bp, Homo sapiens
  misc_feature: HIJSMM301D8Y76.19.86.H09.1.454.light.4.raw
  modified_base (424)..(424): a, c, t, g, unknown or other
tactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctccggtnactctgttcccaccctcctccacgagagta

SEQ ID NO: 538685 - DNA, 447 bp, Homo sapiens; identical to SEQ ID NO: 535020
  misc_feature: HIJSMM301DITL9.18.9.A09.1.454.light.4.raw

SEQ ID NO: 538686 - DNA, 472 bp, Homo sapiens; identical to SEQ ID NO: 537676
  misc_feature: HIJSMM301C234B.4.75.G09.1.454.light.4.raw

SEQ ID NO: 538687 - DNA, 512 bp, Homo sapiens
  misc_feature: HIJSMM301A2MOI.48.34.D01.1.454.light.4.raw
agtatacatacacgaccggtgctcgatttagatcgtctgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggaccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgttctcaacagacaccagtgacaatcatgcgattttcggcggagggaccaagctgaccgtcctgggtcagcccaaggctgccccctcggtcactctgttcccaccct

SEQ ID NO: 538688 - DNA, 482 bp, Homo sapiens
  misc_feature: HIJSMM301AXHDX.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctggacgttcggtccaaggaccgaagtggaaagtacaaacgaaactagtgg

SEQ ID NO: 538689 - DNA, 494 bp, Homo sapiens
  misc_feature: HIJSMM301C9BQW.49.61.F06.1.454.light.4.raw
agtcgagagacacgaccggtgctcgatttagctacgctctaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 538690 - DNA, 500 bp, Homo sapiens
  misc_feature: HIJSMM301BHZP7.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattggggagaaatatgtttgttggtatcaacagaagccaggccagtccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcggggggacaggctgaccggtcggcggtcagcccaaggcgtgccccctccggtcactctgttcccg

SEQ ID NO: 538691 - DNA, 471 bp, Homo sapiens
  misc_feature: HIJSMM301DGCKF.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcgggggtaccaaggtggacatcaaagaa

SEQ ID NO: 538692 - DNA, 493 bp, Homo sapiens; identical to SEQ ID NO: 535084
  misc_feature: HIJSMM301CJE4U.47.64.F09.1.454.light.4.raw

SEQ ID NO: 538693 - DNA, 495 bp, Homo sapiens; identical to SEQ ID NO: 535143
  misc_feature: HIJSMM301BP1N9.51.29.C07.1.454.light.4.raw

SEQ ID NO: 538694 - DNA, 489 bp, Homo sapiens
  misc_feature: HIJSMM301CG69U.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggacccaagctgaccgtcctaggtcagcccaaggctgccccctcggtcactctgttcccgccctctc

SEQ ID NO: 538695 - DNA, 493 bp, Homo sapiens; identical to SEQ ID NO: 535084
  misc_feature: HIJSMM301D7LXV.47.64.F09.1.454.light.4.raw

SEQ ID NO: 538696 - DNA, 353 bp, Homo sapiens; identical to SEQ ID NO: 536338
  misc_feature: HIJSMM301B5J8A.3.11.A11.1.454.light.4.raw

SEQ ID NO: 538697 - DNA, 518 bp, Homo sapiens
  misc_feature: HIJSMM301B34YY.27.23.C01.1.454.light.4.raw
  modified_base (504)..(504): a, c, t, g, unknown or other
agcgtcgtctcacgaccggtgctcgatttagtacacgtgattagggattggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcnctctgttcccgcct

SEQ ID NO: 538698 - DNA, 477 bp, Homo sapiens
  misc_feature: HIJSMM301BDSUR.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatcgtgggacagggtattttaatttctaccatcagcacgcctccaacgtgatgatgttgcaacatactattgtcagcaatatgtatttgtctcctccgagtgcctacttttggcggtagggaccgagggtggacgatac

SEQ ID NO: 538699 - DNA, 446 bp, Homo sapiens
  misc_feature: HIJSMM301D0XRT.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtcccgtcgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccaccctcctccgtgtctgat

SEQ ID NO: 538700 - DNA, 487 bp, Homo sapiens; identical to SEQ ID NO: 537573
  misc_feature: HIJSMM301C8IZP.3.10.A10.1.454.light.4.raw

SEQ ID NO: 538701 - DNA, 487 bp, Homo sapiens
  misc_feature: HIJSMM301BJ4ME.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaacaccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttcccctcactttcggcggagggaccaaggtggagatcaagcgaactgtggctgcaccatctgtt

SEQ ID NO: 538702 - DNA, 507 bp, Homo sapiens
  misc_feature: HIJSMM301BDJQF.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgcc

SEQ ID NO: 538703 - DNA, 415 bp, Homo sapiens
  misc_feature: HIJSMM301EWW1N.18.78.H01.1.454.light.4.raw
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaattggccctcaggggtttctaatcgcttctctggctccaagtctgacaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccaccctcctccatactcgta

SEQ ID NO: 538704 - DNA, 506 bp, Homo sapiens
  misc_feature: HIJSMM301CK9RN.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtacaaacgaactagtggctgcaccatctgtcttctatcttccccg

SEQ ID NO: 538705 - DNA, 488 bp, Homo sapiens; identical to SEQ ID NO: 537504
  misc_feature: HIJSMM301AZXK5.17.57.F02.1.454.light.4.raw

SEQ ID NO: 538706 - DNA, 502 bp, Homo sapiens
  misc_feature: HIJSMM301A3OAM.19.10.A10.1.454.light.4.raw
tactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgaagattttgcagtgtattactgtcaacgatatgatgagtcacctccgtggtggacatttggccaggggaccaaggttgaagtcaaacgaactgtggctgcaccatctgtcttcatcttcccg

SEQ ID NO: 538707 - DNA, 507 bp, Homo sapiens
  misc_feature: HIJSMM301DBC9Y.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcgcggtgggaccaagctgaccgtctaagtcagcccaaggctgccccctcggtcactctgtt

SEQ ID NO: 538708 - DNA, 497 bp, Homo sapiens; identical to SEQ ID NO: 535740
  misc_feature: HIJSMM301D2FLO.3.71.G05.1.454.light.4.raw

SEQ ID NO: 538709 - DNA, 499 bp, Homo sapiens
  misc_feature: HIJSMM301CU9K4.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtctaggtcagcccaaggccaaccccac

SEQ ID NO: 538710 - DNA, 486 bp, Homo sapiens; identical to SEQ ID NO: 535082
  misc_feature: HIJSMM301BPC0T.3.55.E11.1.454.light.4.raw

SEQ ID NO: 538711 - DNA, 473 bp, Homo sapiens
  misc_feature: HIJSMM301EP2TD.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaaggtggaaatcaaacgaactagtgg

SEQ ID NO: 538712 - DNA, 486 bp, Homo sapiens; identical to SEQ ID NO: 535043
  misc_feature: HIJSMM301BDQCA.46.35.D02.1.454.light.4.raw

SEQ ID NO: 538713 - DNA, 494 bp, Homo sapiens; identical to SEQ ID NO: 534992
  misc_feature: HIJSMM301A9NJ9.9.1.A01.1.454.light.4.raw

SEQ ID NO: 538714 - DNA, 490 bp, Homo sapiens
  misc_feature: HIJSMM301C4XW4.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgccccctcggtcactc

SEQ ID NO: 538715 - DNA, 521 bp, Homo sapiens
  misc_feature: HIJSMM301DF80Z.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 538716 - DNA, 505 bp, Homo sapiens
  misc_feature: HIJSMM301EH0NQ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccaaggtggaaagtcaaacgaactagtggctgcaccatctgtcttcatcttccccg

SEQ ID NO: 538717 - DNA, 415 bp, Homo sapiens; identical to SEQ ID NO: 536118
  misc_feature: HIJSMM301CLCCF.18.78.H01.1.454.light.4.raw

SEQ ID NO: 538718 - DNA, 383 bp, Homo sapiens; identical to SEQ ID NO: 447524
  misc_feature: HIJSMM301BQIY7.41.26.C04.1.454.light.4.raw

SEQ ID NO: 538719 - DNA, 445 bp, Homo sapiens
  misc_feature: HIJSMM301BU364.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctccagggtcgtctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctccactactatg

SEQ ID NO: 538720 - DNA, 503 bp, Homo sapiens; identical to SEQ ID NO: 535044
  misc_feature: HIJSMM301EBEYJ.19.78.H01.1.454.light.4.raw

SEQ ID NO: 538721 - DNA, 481 bp, Homo sapiens
  misc_feature: HIJSMM301DFGGR.48.19.B08.1.454.light.4.raw
agtatacatacacgaccggtgctcgatttagtgagtcagtaaggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagccc

SEQ ID NO: 538722 - DNA, 486 bp, Homo sapiens; identical to SEQ ID NO: 535043
  misc_feature: HIJSMM301CXW44.46.35.D02.1.454.light.4.raw

SEQ ID NO: 538723 - DNA, 493 bp, Homo sapiens; identical to SEQ ID NO: 535745
  misc_feature: HIJSMM301AHBHW.47.78.H01.1.454.light.4.raw

SEQ ID NO: 538724 - DNA, 497 bp, Homo sapiens; identical to SEQ ID NO: 536371
  misc_feature: HIJSMM301B7XB8.16.78.H01.1.454.light.4.raw

SEQ ID NO: 538725 - DNA, 478 bp, Homo sapiens; identical to SEQ ID NO: 535129
  misc_feature: HIJSMM301EZII4.11.11.A11.1.454.light.4.raw

SEQ ID NO: 538726 - DNA, 487 bp, Homo sapiens
  misc_feature: HIJSMM301EGOJ0.48.60.F05.1.454.light.4.raw
agtatacatacacgaccggtgctcgatttagtacgtcatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccagacgattccctggagtgccagagaggttcagtggcagcggagcagggacagagttcacactgaaaatcagccgggtggaggctgaggatgttggcctttattactgcatgcaaggtatcttcctcccatacacttttggcccggggaccaaggtggatctcaaagaactgtggctgcacc

SEQ ID NO: 538727 - DNA, 401 bp, Homo sapiens
  misc_feature: HIJSMM301BH2XQ.19.10.A10.1.454.light.4.raw
tactctcgtgcacgaccggtgctcgatttagcgtcgatctcagggggaggaagagctgctcagttaggacccacgagggaaccgatggaaccccacgcgcagcttctcttcctcctgctactctggctcccagatagcaccggagaaattttcttgacgcagtctccaggcaccctgtctttgaccactggcatccccgacaggttcagtggcagtgtgtctgggacagacttcactctcaccatcagcagactggagcctgaagatttgtcagtgtattactgtcaacgatatgatgagtcacctccgtggtggacatttggccaggggaccaaggttgagtcaaacgaactgtggctgcaccatctgtcttcatcttcccgccatctgacacgagagta

SEQ ID NO: 538728 - DNA, 479 bp, Homo sapiens
  misc_feature: HIJSMM301AUU55.41.5.A05.1.454.light.4.raw
tctatactatcacgaccggtgctcgatttagatagatagacaggggcaggagtcagacccagtcaggacacagcatggacatgagggtccccgctcagctcctggggctcctgctgctctggttcccaggttccagatgcgacatccagctgacccagtctccatcttctgtgtctgcatctgtaggagacagagtcaacatcacttgtcgggcgagtcagggtattaccagctggttagcctggtatcagcagaaaccagggaaagcccctaaactcctgatctatgctgcatccagtttgcaaagtggggtcccatcaagattcagaggcagtggatctgggacagatttcactctcactatcaacagcctgcagcctgaagattttgccacttactattgtcaacaggctgacagtttccccttcaccttcggccaagggacacgactggacattaaacgaactgtggctgcacca

SEQ ID NO: 538729 - DNA, 447 bp, Homo sapiens; identical to SEQ ID NO: 535882
  misc_feature: HIJSMM301B95LZ.18.9.A09.1.454.light.4.raw
  modified_base (429)..(429): a, c, t, g, unknown or other

SEQ ID NO: 538730 - DNA, 502 bp, Homo sapiens
  misc_feature: HIJSMM301CO75X.15.1.A01.1.454.light.4.raw
tctacgtagccacgaccggtgctcgatttagacgtctcatcaggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcact

SEQ ID NO: 538731 - DNA, 513 bp, Homo sapiens
  misc_feature: HIJSMM301DFWVK.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccacctcctcc

SEQ ID NO: 538732 - DNA, 443 bp, Homo sapiens
  misc_feature: HIJSMM301AHOJX.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccaccctctcagacgtatca

SEQ ID NO: 538733 - DNA, 509 bp, Homo sapiens
  misc_feature: HIJSMM301AXEDJ.15.86.H09.1.454.light.4.raw
tctacgtagccacgaccggtgctcgatttagtgctatagacttgggtttgggggacttccctggtctccttctacctactgcccttcatttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttccccacctcctcgctacgt

SEQ ID NO: 538734 - DNA, 479 bp, Homo sapiens
  misc_feature: HIJSMM301CDW00.8.53.E09.1.454.light.4.raw
ctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggacc

SEQ ID NO: 538735 - DNA, 499 bp, Homo sapiens
  misc_feature: HIJSMM301BOLNP.41.18.B07.1.454.light.4.raw
tctatactatcacgaccggtgctcgatttagtcgctgcgtaagggggtgtgggtccaggaggcagaactctgggtgtctcaccatggcctggatccctctacttctcccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccgaagctgaccgtcctaggtcagcccaaggctgccccctcggtcactcttcg

SEQ ID NO: 538736 - DNA, 496 bp, Homo sapiens; identical to SEQ ID NO: 538149
  misc_feature: HIJSMM301DAQOH.13.67.G01.1.454.light.4.raw

SEQ ID NO: 538737 - DNA, 509 bp, Homo sapiens
  misc_feature: HIJSMM301ATYXU.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagacgtgaccgtccctaggtcgagcccaacggctgccccctccggtcgactctgttccccg

SEQ ID NO: 538738 - DNA, 481 bp, Homo sapiens
  misc_feature: HIJSMM301BT89B.41.34.D01.1.454.light.4.raw
tctatactatcacgaccggtgctcgatttagatcgtctgtgttgggtttggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcaca

SEQ ID NO: 538739 - DNA, 383 bp, Homo sapiens; identical to SEQ ID NO: 447524
  misc_feature: HIJSMM301BB5GK.41.26.C04.1.454.light.4.raw

SEQ ID NO: 538740 - DNA, 488 bp, Homo sapiens; identical to SEQ ID NO: 535169
  misc_feature: HIJSMM301DWUOJ.16.72.G06.1.454.light.4.raw

SEQ ID NO: 538741 - DNA, 447 bp, Homo sapiens; identical to SEQ ID NO: 535020
  misc_feature: HIJSMM301EPNDE.18.9.A09.1.454.light.4.raw

SEQ ID NO: 538742 - DNA, 498 bp, Homo sapiens
  misc_feature: HIJSMM301D1Y4V.43.25.C03.1.454.light.4.raw
tgtgagtagtcacgaccggtgctcgatttagtagtgtagatttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttggggtttattactgcatgcaaggtacacactggcccgtcaccttcggccaagggacacgactggagattaaacgaactgtggctgcacca

SEQ ID NO: 538743 - DNA, 473 bp, Homo sapiens
  misc_feature: HIJSMM301BBS00.8.67.G01.1.454.light.4.raw
ctcgcgtgtccacgaccggtgctcgatttagagtatacatattgggtttgggggcttttcctgggctcctgctactctggctccgaggtgccagatgtgatatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtcttcatcttcccgccatctgagacacgcgag

SEQ ID NO: 538744 - DNA, 489 bp, Homo sapiens
  misc_feature: HIJSMM301D5ZJ4.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccatctgt

SEQ ID NO: 538745 - DNA, 485 bp, Homo sapiens; identical to SEQ ID NO: 536576
  misc_feature: HIJSMM301EFGJ0.46.35.D02.1.454.light.4.raw

SEQ ID NO: 538746 - DNA, 488 bp, Homo sapiens
  misc_feature: HIJSMM301A3E5I.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatactgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccatct

SEQ ID NO: 538747 - DNA, 494 bp, Homo sapiens
  misc_feature: HIJSMM301APW71.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccaccctcctcacgcg

SEQ ID NO: 538748 - DNA, 504 bp, Homo sapiens; identical to SEQ ID NO: 535561
  misc_feature: HIJSMM301EW5ZL.4.57.F02.1.454.light.4.raw

SEQ ID NO: 538749 - DNA, 498 bp, Homo sapiens
  misc_feature: HIJSMM301C375X.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccca

SEQ ID NO: 538750 - DNA, 488 bp, Homo sapiens
  misc_feature: HIJSMM301C5FXY.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgtcgtccaggaccgaacggtaggagtaatcagacgaa

SEQ ID NO: 538751 - DNA, 486 bp, Homo sapiens
  misc_feature: HIJSMM301D5N0V.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcacgtcctaggtcagcccaaggccaacccca

SEQ ID NO: 538752 - DNA, 480 bp, Homo sapiens
  misc_feature: HIJSMM301DDSBS.7.76.G10.1.454.light.4.raw
cgtgtctctacacgaccggtgctcgatttagtcactcatacaggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaaggtaggaggatcaacgaaactgtggctgcacc

SEQ ID NO: 538753 - DNA, 493 bp, Homo sapiens
  misc_feature: HIJSMM301CZFQH.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttacctcaagtgatcaccttcggccaagggacacgactggagattaaacgaactgtggctgcaccatctgtctt

SEQ ID NO: 538754 - DNA, 486 bp, Homo sapiens
  misc_feature: HIJSMM301BAI5C.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggccctgggactaaggtggaggatcagacgaactgtggctgcaccatctgtcttcta

SEQ ID NO: 538755 - DNA, 515 bp, Homo sapiens
  misc_feature: HIJSMM301A06GR.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaacccactgtcactctcg

SEQ ID NO: 538756 - DNA, 500 bp, Homo sapiens
  misc_feature: HIJSMM301EKQRB.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccagggggaccaagctggagatcaaacgaactgtggctgcaccatctgtcttcatt

SEQ ID NO: 538757 - DNA, 518 bp, Homo sapiens
  misc_feature: HIJSMM301CHUPU.52.57.F02.1.454.light.4.raw
cgcagtacgacacgaccggtgctcgatttagctcgatatagttgggtttgggggggtcgtcaggaggcagcgctctcaggacgtcaccaccatggcctgggcgtctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgagggctgattactactgcacctcatatgcaggcgacaacaatttgggggttttcggcggagggaccaaggtgaccgtcctacgtcagcccaaggctgccccctcggtcactctgtt

SEQ ID NO: 538758 - DNA, 484 bp, Homo sapiens
  misc_feature: HIJSMM301EPA51.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgcagtctattactgtcagcagtatggtcacgtccaagaacttttggccaggggaccaagctggagatcaaacgaactgtggctgcaccat

SEQ ID NO: 538759 - DNA, 485 bp, Homo sapiens; identical to SEQ ID NO: 536576
  misc_feature: HIJSMM301D6CHI.46.35.D02.1.454.light.4.raw

SEQ ID NO: 538760 - DNA, 485 bp, Homo sapiens
  misc_feature: HIJSMM301CD8VZ.3.88.H11.1.454.light.4.raw
agacgcactccacgaccggtgctcgatttagcgacagcgagaacacacaaaggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcagggggatctgggacagatttcactctcaccatcagcagcctgcagcctgaagattttgcaacttactattgtcaacaggctaacagtttccctttaatcttcggccaagggacacgactggagattaaacgaactgtggctgcacca

SEQ ID NO: 538761 - DNA, 477 bp, Homo sapiens
  misc_feature: HIJSMM301CSM50.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccaaggtggagatcaaacgaactgtggctgcac

SEQ ID NO: 538762 - DNA, 494 bp, Homo sapiens; identical to SEQ ID NO: 535478
  misc_feature: HIJSMM301BEOGD.10.79.H02.1.454.light.4.raw

SEQ ID NO: 538763 - DNA, 464 bp, Homo sapiens
  misc_feature: HIJSMM301C53AT.49.4.A04.1.454.light.4.raw
agtcgagagacacgaccggtgctcgatttagagtagtgatcaggggcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcgggggaccgaaggtggagatcaagcgaactgtgg

SEQ ID NO: 538764 - DNA, 492 bp, Homo sapiens; identical to SEQ ID NO: 535126
  misc_feature: HIJSMM301AVOTS.18.11.A11.1.454.light.4.raw

SEQ ID NO: 538765 - DNA, 489 bp, Homo sapiens
  misc_feature: HIJSMM301EHHM2.15.1.A01.1.454.light.4.raw
  modified_base (436)..(436): a, c, t, g, unknown or other
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaacctacatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcancccaaggctcgccccctcggtcactctcgttcccgccctcctcgctacgtaga

SEQ ID NO: 538766 - DNA, 466 bp, Homo sapiens; identical to SEQ ID NO: 535366
  misc_feature: HIJSMM301D4CRE.13.4.A04.1.454.light.4.raw

SEQ ID NO: 538767 - DNA, 510 bp, Homo sapiens
  misc_feature: HIJSMM301C9LLI.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccccg

SEQ ID NO: 538768 - DNA, 495 bp, Homo sapiens; identical to SEQ ID NO: 535596
  misc_feature: HIJSMM301AZVCS.10.79.H02.1.454.light.4.raw

SEQ ID NO: 538769 - DNA, 509 bp, Homo sapiens
  misc_feature: HIJSMM301C3MHX.16.83.H06.1.454.light.4.raw
tgtactactccacgaccggtgctcgatttagatcacgtgcgtcgcggagagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaaccccactgtcactctgttccca

SEQ ID NO: 538770 - DNA, 484 bp, Homo sapiens
  misc_feature: HIJSMM301BXTOZ.4.57.F02.1.454.light.4.raw
agcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcacc

SEQ ID NO: 538771 - DNA, 508 bp, Homo sapiens
  misc_feature: HIJSMM301ADQWX.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccgaaggtggagatcaaacgaactgtggctgcaccatctgtcttcta

SEQ ID NO: 538772 - DNA, 494 bp, Homo sapiens; identical to SEQ ID NO: 534992
  misc_feature: HIJSMM301AQ7TM.9.1.A01.1.454.light.4.raw

SEQ ID NO: 538773 - DNA, 498 bp, Homo sapiens
  misc_feature: HIJSMM301CMKNZ.49.67.G01.1.454.light.4.raw
agtcgagagacacgaccggtgctcgatttagagtatacatattgggtttgggcacgaccggtgctcgatttagagtatacatattgggtttggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggcc

SEQ ID NO: 538774 - DNA, 499 bp, Homo sapiens
  misc_feature: HIJSMM301C5GZZ.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatcaaacgaactagtggctgcacc

SEQ ID NO: 538775 - DNA, 505 bp, Homo sapiens; identical to SEQ ID NO: 535987
  misc_feature: HIJSMM301ELR3X.18.37.D04.1.454.light.4.raw

SEQ ID NO: 538776 - DNA, 520 bp, Homo sapiens
  misc_feature: HIJSMM301BXEZB.14.55.E11.1.454.light.4.raw
  modified_base (425)..(425): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccncctctacgttcggacgggacgaaccgaggacgaagtctacgaacggaaccgtaacgttggcggtctcgacccaacctacttcgttcgttacctta

SEQ ID NO: 538777 - DNA, 499 bp, Homo sapiens; identical to SEQ ID NO: 537739
  misc_feature: HIJSMM301DYBEX.12.86.H09.1.454.light.4.raw

SEQ ID NO: 538778 - DNA, 502 bp, Homo sapiens
  misc_feature: HIJSMM301CJYLZ.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttctatcctccgtggacgttcggccaagggaccaggtggaaatcagacgaactgtggctgcaccat

SEQ ID NO: 538779 - DNA, 485 bp, Homo sapiens
  misc_feature: HIJSMM301CIJD4.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtacccgtacacttttggccaggggaccaaactggacatcaacgaactgtggctgcaccatctgt

SEQ ID NO: 538780 - DNA, 482 bp, Homo sapiens; identical to SEQ ID NO: 537205
  misc_feature: HIJSMM301AY9F4.5.39.D06.1.454.light.4.raw

SEQ ID NO: 538781 - DNA, 516 bp, Homo sapiens
  misc_feature: HIJSMM301CMEWT.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgacggaccgaacggtaggaaggtacaacgaaacctagtggcgtgcaccactctgtcttctactcttcccgtccact

SEQ ID NO: 538782 - DNA, 487 bp, Homo sapiens; identical to SEQ ID NO: 536206
  misc_feature: HIJSMM301BT64I.47.38.D05.1.454.light.4.raw

SEQ ID NO: 538783 - DNA, 492 bp, Homo sapiens; identical to SEQ ID NO: 537666
  misc_feature: HIJSMM301BADY2.43.33.C11.1.454.light.4.raw

SEQ ID NO: 538784 - DNA, 496 bp, Homo sapiens
  misc_feature: HIJSMM301ENSVS.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttctaaacgaactagtggctgcaccatctgtcttcat

SEQ ID NO: 538785 - DNA, 478 bp, Homo sapiens
  misc_feature: HIJSMM301CPHQI.13.76.G10.1.454.light.4.raw
  modified_base (429)..(429): a, c, t, g, unknown or other
tcacgtactacacgaccggtgctcgatttagtcactcatacagggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgntatgtcttcggaactgggaccaaggtcaccggtcctaagtcagaccccg

SEQ ID NO: 538786 - DNA, 478 bp, Homo sapiens
  misc_feature: HIJSMM301AMKC9.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttacccctcccactttcggcggagggaccaaggtggagatcaaacgaactgtggctgcaccatctgtt

SEQ ID NO: 538787 - DNA, 485 bp, Homo sapiens
  misc_feature: HIJSMM301DA03C.49.57.F02.1.454.light.4.raw
agtcgagagacacgaccggtgctcgatttagctcgatatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaaacg

SEQ ID NO: 538788 - DNA, 492 bp, Homo sapiens
  misc_feature: HIJSMM301B7LYG.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcacttcggtcggagggaccgaaggtggagagtcaaacgaactagtggctgcaccat

SEQ ID NO: 538789 - DNA, 444 bp, Homo sapiens; identical to SEQ ID NO: 535027
  misc_feature: HIJSMM301BITH7.8.73.G07.1.454.light.4.raw

SEQ ID NO: 538790 - DNA, 495 bp, Homo sapiens
  misc_feature: HIJSMM301CANQD.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaacgtggacgatcaagcgaactagtggctgcaccatctgtt

SEQ ID NO: 538791 - DNA, 442 bp, Homo sapiens
  misc_feature: HIJSMM301AE4AQ.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctccggtcactctgttcccgccctcctcgtatctctcg

SEQ ID NO: 538792 - DNA, 445 bp, Homo sapiens
  misc_feature: HIJSMM301CAOTT.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccgaccctcctccgtgtctgat

SEQ ID NO: 538793 - DNA, 473 bp, Homo sapiens
  misc_feature: HIJSMM301EOI1W.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaagggacacgactggagattaaacgaa

SEQ ID NO: 538794 - DNA, 494 bp, Homo sapiens; identical to SEQ ID NO: 534992
  misc_feature: HIJSMM301D8JB7.9.1.A01.1.454.light.4.raw

SEQ ID NO: 538795 - DNA, 498 bp, Homo sapiens
  misc_feature: HIJSMM301CWCEK.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcaggggacccaggccttggatgaggctgactatcactgtcaggcgtgggacagcaacactgcgattttcggcgggggaccaggctgaccgtcggcggtcagcccaaggctgccccctcggtcactctgttcccg

SEQ ID NO: 538796 - DNA, 494 bp, Homo sapiens
  misc_feature: HIJSMM301D5EKA.48.44.D11.1.454.light.4.raw
agtatacatacacgaccggtgctcgatttagcgcagtacgaagggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcaccat

SEQ ID NO: 538797 - DNA, 495 bp, Homo sapiens; identical to SEQ ID NO: 535486
  misc_feature: HIJSMM301CWUYT.26.72.G06.1.454.light.4.raw

SEQ ID NO: 538798 - DNA, 503 bp, Homo sapiens
  misc_feature: HIJSMM301EOFGI.14.86.H09.1.454.light.4.raw
cgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagctccctagagcctggagattttgtagtttattactgtcagcagtatagcagctggcctcccactttcggcggagggaccaaggtggagatccaacgaactgtggctgcaccatctgtcttcatcttcccg

SEQ ID NO: 538799 - DNA, 505 bp, Homo sapiens
  misc_feature: HIJSMM301DHXUD.12.53.E09.1.454.light.4.raw
atacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctcgccccctcggtcactctgtttccaccctcctctacgtcgtat

SEQ ID NO: 538800 - DNA, 489 bp, Homo sapiens
  misc_feature: HIJSMM301ALJ45.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatcccagatgacccagtcgtccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttc

SEQ ID NO: 538801 - DNA, 502 bp, Homo sapiens
  misc_feature: HIJSMM301BF4DH.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagtctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaacccactgtca

SEQ ID NO: 538802 - DNA, 491 bp, Homo sapiens; identical to SEQ ID NO: 537594
  misc_feature: HIJSMM301BKFBB.4.24.C02.1.454.light.4.raw

SEQ ID NO: 538803 - DNA, 405 bp, Homo sapiens
  misc_feature: HIJSMM301ADX37.4.35.D02.1.454.light.4.raw
agcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaaccccactgtcactctgttcccgccctcctcctacagtgct

SEQ ID NO: 538804 - DNA, 477 bp, Homo sapiens
  misc_feature: HIJSMM301EAQMM.48.41.D08.1.454.light.4.raw
agtatacatacacgaccggtgctcgatttagtcacgcgagaaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattatactgctgctcatatgcaggcagctacactttggtgttcggcgagggaccaagctgactgtcc

SEQ ID NO: 538805 - DNA, 515 bp, Homo sapiens
  misc_feature: HIJSMM301A2PSP.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccaccctcctcg

SEQ ID NO: 538806 - DNA, 486 bp, Homo sapiens; identical to SEQ ID NO: 535043
  misc_feature: HIJSMM301CG9Y2.46.35.D02.1.454.light.4.raw

SEQ ID NO: 538807 - DNA, 523 bp, Homo sapiens
  misc_feature: HIJSMM301EH1TX.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccgggacgttcggtccgaacggaaccgaacggtaggaaggtacgaaacgaactacgtggcgtgcaccactctgtcttctactcttcccgtccact

SEQ ID NO: 538808 - DNA, 504 bp, Homo sapiens
  misc_feature: HIJSMM301BZMWW.48.71.G05.1.454.light.4.raw
agtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaacctggccagcctcccaggctcctcatctatggtgcgtccaccagggccactggcatcccagacaggttcagtggcagtgggtctgggacagacttcactctcaccatcaccagactggagcctgatgattttgcagtgttttctgtcagcagtatggaagttcacctcggacattcggccaggggaccaaggtggaaatcaaacgaactgtggctgcaccatctgtcttcatcttcccg

SEQ ID NO: 538809 - DNA, 509 bp, Homo sapiens; identical to SEQ ID NO: 536047
  misc_feature: HIJSMM301AHPL9.17.33.C11.1.454.light.4.raw

SEQ ID NO: 538810 - DNA, 489 bp, Homo sapiens
  misc_feature: HIJSMM301D3YHP.47.48.E04.1.454.light.4.raw
agctcacgtacacgaccggtgctcgatttagagagcgtcacagagagaagggggaatcagtcccactcaggacacagcatggacatgacgggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccgaacggaccaaggtggaaatacaaacgaactagtggcgtgcaccta

SEQ ID NO: 538811 - DNA, 488 bp, Homo sapiens
  misc_feature: HIJSMM301BDP58.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagaccccg

SEQ ID NO: 538812 - DNA, 521 bp, Homo sapiens
  misc_feature: HIJSMM301BPNKL.9.25.C03.1.454.light.4.raw
tgatacgtctcacgaccggtgctcgatttagtagtgtagatttgggtttggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcgggtcgaagccggggatgaggccgactattctgtcagctgtgggattctcatgatggtagtgggggaatcttcggcggagggaccaggctgaccgtcctaagtcagcccaaggctgcccctcggtcactctgttccgccctcctcagacg

SEQ ID NO: 538813 - DNA, 488 bp, Homo sapiens
  misc_feature: HIJSMM301DAF9B.19.71.G05.1.454.light.4.raw
tactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 538814 - DNA, 484 bp, Homo sapiens; identical to SEQ ID NO: 535211
  misc_feature: HIJSMM301AR7RA.47.46.E02.1.454.light.4.raw

SEQ ID NO: 538815 - DNA, 482 bp, Homo sapiens
  misc_feature: HIJSMM301AF4BY.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagattttgcggtttattactgtcagcagtatgataactggctgtacacttttggccaggggaccaagctggagatcaggcgaactgtggctgca

SEQ ID NO: 538816 - DNA, 493 bp, Homo sapiens
  misc_feature: HIJSMM301BM4R5.48.37.D04.1.454.light.4.raw
agtatacatacacgaccggtgctcgatttagtagcatactgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctcctgaccgtctctgggctccaggctgaggatgaggctgattattactgcagctcatatgcaggcagcaacaatgtggtattcggcggagggaccaagctgaccgtcctaggtcagcccaagg

SEQ ID NO: 538817 - DNA, 484 bp, Homo sapiens; identical to SEQ ID NO: 535441
  misc_feature: HIJSMM301A2E3V.26.60.F05.1.454.light.4.raw

SEQ ID NO: 538818 - DNA, 350 bp, Homo sapiens; identical to SEQ ID NO: 537421
  misc_feature: HIJSMM301BKZ6A.13.11.A11.1.454.light.4.raw

SEQ ID NO: 538819 - DNA, 463 bp, Homo sapiens; identical to SEQ ID NO: 535008
  misc_feature: HIJSMM301EO0YH.10.9.A09.1.454.light.4.raw

SEQ ID NO: 538820 - DNA, 502 bp, Homo sapiens
  misc_feature: HIJSMM301CIGUO.15.86.H09.1.454.light.4.raw
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttggtgttcggcggagggaccaagctgaccgtcctaggtcagcccaaggctgccccctggtcactctgttccccaccctctcg

SEQ ID NO: 538821 - DNA, 495 bp, Homo sapiens
  misc_feature: HIJSMM301CIWMS.13.38.D05.1.454.light.4.raw
tcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagaggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaaactgt

SEQ ID NO: 538822 - DNA, 417 bp, Homo sapiens
  misc_feature: HIJSMM301A3BGW.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctctatgtcttcggaactgggaccaaggtcaccgtcctaggtcagcccaaggccaacccactgtcactctgttcccaccctcctccatactcgta

SEQ ID NO: 538823 - DNA, 354 bp, Homo sapiens; identical to SEQ ID NO: 535026
  misc_feature: HIJSMM301AF58N.19.22.B11.1.454.light.4.raw

SEQ ID NO: 538824 - DNA, 485 bp, Homo sapiens
  misc_feature: HIJSMM301DWHDL.48.57.F02.1.454.light.4.raw
agtatacatacacgaccggtgctcgatttagctcgatatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaagg

SEQ ID NO: 538825 - DNA, 497 bp, Homo sapiens
  misc_feature: HIJSMM301DBT68.3.10.A10.1.454.light.4.raw
agacgcactccacgaccggtgctcgatttagcgtcgatctcaggggagagctctggggaggaactgctcagttaggacccagacggaaccatggaagccccagcgcagcttctcttcctcctgctactctggctcccagatgccactggagaaatagtgatggcgcagtctccagccaccctgtctgtgtctccaggggaaagagccaccctctcctgcagggccagtcagtctgtttataacaacttagcctggtaccaacagagacctggccaggctcccaggctcctcatgtttggtgcttccaccagggccactggtatcccagccaggttcagtggcagtgggtctgggacagagttcactctcaccatcagcagcctgcagtctgaagattttgcaatttatttctgtcagcagtacaataattggcctttgacgttcggccaagggaccaaggtggaaactaaacgaactgtggctgcaccatctgtctt

SEQ ID NO: 538826 - DNA, 485 bp, Homo sapiens; identical to SEQ ID NO: 535609
  misc_feature: HIJSMM301CN4WV.46.35.D02.1.454.light.4.raw

SEQ ID NO: 538827 - DNA, 487 bp, Homo sapiens
  misc_feature: HIJSMM301APC7E.46.35.D02.1.454.light.4.raw
  modified_base (455)..(455): a, c, t, g, unknown or other
actagcagtacacgaccggtgctcgatttagcacacgatagttgggtttggggagctgctcagttaggacccagagggaaccatggaaaccccacgcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggctagggaccgaanctggagatacaaacgaactgtggctgcaccat

SEQ ID NO: 538828 - DNA, 496 bp, Homo sapiens; identical to SEQ ID NO: 535541
  misc_feature: HIJSMM301AJU8Z.3.33.C11.1.454.light.4.raw

SEQ ID NO: 538829 - DNA, 483 bp, Homo sapiens; identical to SEQ ID NO: 535413
  misc_feature: HIJSMM301ANR0Q.26.78.H01.1.454.light.4.raw

SEQ ID NO: 538830 - DNA, 498 bp, Homo sapiens
  misc_feature: HIJSMM301CD2I5.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggtccgaagggaccgaaggtggaaggtacaaacgaactagtggcgtgcaccatctgtctt

SEQ ID NO: 538831 - DNA, 475 bp, Homo sapiens
  misc_feature: HIJSMM301DDV0Q.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggctgggacagcagcactgcccgctatgtcttcggaactgggaccaaggtcaccgtcctaagtcagaccccg

SEQ ID NO: 538832 - DNA, 493 bp, Homo sapiens
  misc_feature: HIJSMM301DM13X.43.32.C10.1.454.light.4.raw
tgtgagtagtcacgaccggtgctcgatttagtatagacatcaacacacaaagggggagctacaacaggcaggcagggcagcaagatggtgttgcagacccaggtcttcatttctctgttgctctggatctctggtgcctacggggacttcgtgatgacccagtctccagactccctggctgtgtcgctgggcgacagggccaccatcgactgcaagtccagccagagtgttttatacagctccaacaataagaactacttagcttggtaccagcataaaccaggacagactcctaaactgctcatttactgggcttctacccgggaatccgggtccctgaccgattcagtggcagcgggtctgggacagattttcactctcaccatcagcagcctgcaggctgaagatgtggcagtttattactgtcaacaatattatactattccgtacagttttggccaggggaccaagctggagatcaaacgaactgtgg

SEQ ID NO: 538833 - DNA, 516 bp, Homo sapiens; identical to SEQ ID NO: 535549
  misc_feature: HIJSMM301CN4R6.14.70.G04.1.454.light.4.raw

SEQ ID NO: 538834 - DNA, 484 bp, Homo sapiens; identical to SEQ ID NO: 536162
  misc_feature: HIJSMM301D675O.13.59.F04.1.454.light.4.raw

SEQ ID NO: 538835 - DNA, 488 bp, Homo sapiens
  misc_feature: HIJSMM301AGENR.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggtcggagggaccaaggtggagatcaaacgaactgtggctgcaccatctgtcttc

SEQ ID NO: 538836 - DNA, 422 bp, Homo sapiens
  misc_feature: HIJSMM301EJUNM.41.14.B03.1.454.light.4.raw
tctatactatcacgaccggtgctcgatttagtgtgagtagttccgcgggcacgaccggtgctcgatttagtgtgagtagtttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 538837 - DNA, 510 bp, Homo sapiens
  misc_feature: HIJSMM301EWAYH.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccaaggtaggaaagtacaaacgaacctagtggctgcgaccatctgtcttctatcttccccg

SEQ ID NO: 538838 - DNA, 496 bp, Homo sapiens
  misc_feature: HIJSMM301AQ9ER.51.34.D01.1.454.light.4.raw
cgatcgtatacacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 538839 - DNA, 493 bp, Homo sapiens
  misc_feature: HIJSMM301AUAGX.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggacgaacggacggagatcagacgaactgtggcgtgcaccactctgtcttcta

SEQ ID NO: 538840 - DNA, 485 bp, Homo sapiens
  misc_feature: HIJSMM301C9WYU.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaa

SEQ ID NO: 538841 - DNA, 494 bp, Homo sapiens
  misc_feature: HIJSMM301A8HND.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtctgcagtataataactggcctccacggtacacttttggccaggggaccaagctggagatcaaacgaactgtggctgcaccatct

SEQ ID NO: 538842 - DNA, 484 bp, Homo sapiens
  misc_feature: HIJSMM301BAHI7.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatct

SEQ ID NO: 538843 - DNA, 489 bp, Homo sapiens
  misc_feature: HIJSMM301AEWCX.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaacggtaggagatcaaacgaa

SEQ ID NO: 538844 - DNA, 510 bp, Homo sapiens; identical to SEQ ID NO: 535474
  misc_feature: HIJSMM301EDDKT.17.33.C11.1.454.light.4.raw

SEQ ID NO: 538845 - DNA, 490 bp, Homo sapiens
  misc_feature: HIJSMM301DXOJL.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcgggtttactactgcatgcagggtacactctggccgttcacttttggccgaggggaccaaactggatatcagacgaactgtggctgca

SEQ ID NO: 538846 - DNA, 513 bp, Homo sapiens; identical to SEQ ID NO: 535719
  misc_feature: HIJSMM301BHSPT.17.33.C11.1.454.light.4.raw

SEQ ID NO: 538847 - DNA, 444 bp, Homo sapiens; identical to SEQ ID NO: 534993
  misc_feature: HIJSMM301EP86A.5.9.A09.1.454.light.4.raw

SEQ ID NO: 538848 - DNA, 477 bp, Homo sapiens; identical to SEQ ID NO: 537678
  misc_feature: HIJSMM301DF80A.12.1.A01.1.454.light.4.raw

SEQ ID NO: 538849 - DNA, 506 bp, Homo sapiens
  misc_feature: HIJSMM301EG3LQ.43.15.B04.1.454.light.4.raw
tgtgagtagtcacgaccggtgctcgatttagacagtatatatccgcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggactttcggccaagggaccaaggtggaattcaaccgaactgtggctgcaccatctgtcttcatcttcccg

SEQ ID NO: 538850 - DNA, 503 bp, Homo sapiens; identical to SEQ ID NO: 535947
  misc_feature: HIJSMM301BQ2W5.9.12.B01.1.454.light.4.raw

SEQ ID NO: 538851 - DNA, 487 bp, Homo sapiens
  misc_feature: HIJSMM301EOFMK.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggaccaaagtaggatatcaaacgaactgtggctgcaccatctgtt

SEQ ID NO: 538852 - DNA, 525 bp, Homo sapiens
  misc_feature: HIJSMM301CYOK8.7.86.H09.1.454.light.4.raw
  modified_base (471)..(471): a, c, t, g, unknown or other
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgtcgtcaggaccgaagtaggngaatacaccgaaactcgtggtcgtgcaccaactctgttcttctatctttccccg

SEQ ID NO: 538853 - DNA, 489 bp, Homo sapiens; identical to SEQ ID NO: 535139
  misc_feature: HIJSMM301AI7FX.14.55.E11.1.454.light.4.raw

SEQ ID NO: 538854 - DNA, 447 bp, Homo sapiens; identical to SEQ ID NO: 535020
  misc_feature: HIJSMM301DSU0O.18.9.A09.1.454.light.4.raw

SEQ ID NO: 538855 - DNA, 497 bp, Homo sapiens
  misc_feature: HIJSMM301CAS49.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctcctgccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtt

SEQ ID NO: 538856 - DNA, 486 bp, Homo sapiens
  misc_feature: HIJSMM301DIVTO.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggcctggggaccaagctggagatcaaacgaactgtggctgcaccat

SEQ ID NO: 538857 - DNA, 487 bp, Homo sapiens
  misc_feature: HIJSMM301DEYGB.4.64.F09.1.454.light.4.raw
agcactgtagcacgaccggtgctcgatttagcgcgtatacaaggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgcaacttacttttgtcaacagactaactcattccctcgcagttttggccaggggaccaaggtggagatcaaacgaactgtggctgcaccatctgtcttcatt

SEQ ID NO: 538858 - DNA, 488 bp, Homo sapiens
  misc_feature: HIJSMM301EWLHB.9.19.B08.1.454.light.4.raw
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccagggtcctcatctttggttacagtaatcggccctcaggggtccctgaccgattctctggctccaagtctgacacctcagcctccctggccatcactgggctccagactgaggatgaggctcattattactgccagtcttatgacaaacgtcagaacatttgggtgttcggcggagggaccaagctgaccgtcctcagtcag

SEQ ID NO: 538859 - DNA, 509 bp, Homo sapiens; identical to SEQ ID NO: 535670
  misc_feature: HIJSMM301B3J5S.47.23.C01.1.454.light.4.raw

SEQ ID NO: 538860 - DNA, 502 bp, Homo sapiens
  misc_feature: HIJSMM301BXRX4.3.25.C03.1.454.light.4.raw
agacgcactccacgaccggtgctcgatttagtagtgtagatttgggtttgggggaggtcagactcagtcaggacacagcatggacatgagggtccccgcctcagctcctggggctcctgctgctctggctcccaggtgccgagggtgacatccagctgacccagtctccctccaccgtgtctgcattcgtaggagacagagtcaccatcacctgtcgggccagtcagagtattaatagttggttggcctggtatcaccagagaccaggtgaagccccaaaactccttatttatgatgcctccactttgaatagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatagagacgaactgtggctgcaccatctgtcttcatcttccccg

SEQ ID NO: 538861 - DNA, 505 bp, Homo sapiens; identical to SEQ ID NO: 536254
  misc_feature: HIJSMM301EJKT2.7.71.G05.1.454.light.4.raw

SEQ ID NO: 538862 - DNA, 513 bp, Homo sapiens
  misc_feature: HIJSMM301A6JYS.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggtccaacgggaccgaaaggtggaaagtacaaacgaactagtggctgcaccactctgtcttctatcttccccg

SEQ ID NO: 538863 - DNA, 490 bp, Homo sapiens; identical to SEQ ID NO: 535234
  misc_feature: HIJSMM301AF6JR.17.21.B10.1.454.light.4.raw

SEQ ID NO: 538864 - DNA, 509 bp, Homo sapiens
  misc_feature: HIJSMM301DJ4Q1.15.86.H09.1.454.light.4.raw
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccgccctcctcgctacgt

SEQ ID NO: 538865 - DNA, 494 bp, Homo sapiens; identical to SEQ ID NO: 534994
  misc_feature: HIJSMM301AG909.27.78.H01.1.454.light.4.raw

SEQ ID NO: 538866 - DNA, 490 bp, Homo sapiens
  misc_feature: HIJSMM301AR045.40.81.H04.1.454.light.4.raw
tctagcgactcacgaccggtgctcgatttagtagtgtagattcgcgggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgca

SEQ ID NO: 538867 - DNA, 505 bp, Homo sapiens; identical to SEQ ID NO: 535503
  misc_feature: HIJSMM301EP9OA.8.28.C06.1.454.light.4.raw

SEQ ID NO: 538868 - DNA, 453 bp, Homo sapiens; identical to SEQ ID NO: 535173
  misc_feature: HIJSMM301DHZE5.19.86.H09.1.454.light.4.raw

SEQ ID NO: 538869 - DNA, 493 bp, Homo sapiens
  misc_feature: HIJSMM301E255B.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttcttcgatcaccttcggccaagggacacgaactggagattaaacgaactagtggcgtgcacccaatctgtt

SEQ ID NO: 538870 - DNA, 484 bp, Homo sapiens
  misc_feature: HIJSMM301D2L73.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccaggggaccaggctggagatcagacgaactgtggc

SEQ ID NO: 538871 - DNA, 444 bp, Homo sapiens; identical to SEQ ID NO: 536685
  misc_feature: HIJSMM301EHFNS.10.76.G10.1.454.light.4.raw

SEQ ID NO: 538872 - DNA, 493 bp, Homo sapiens
  misc_feature: HIJSMM301DKN9V.43.16.B05.1.454.light.4.raw
tgtgagtagtcacgaccggtgctcgatttagagctcacgtaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaacatcacttgccgggcaagtcagactatcaacacccatttaaattggtatcagcagaaacgagggaaagcccctaaactcctgatttatgttgcatccactttacaaactggggtcccatcaaggttcagtggcagtggatctggggcagatttcactctcaacatcggcagtgttcaacctgaagattttgcgacttattatgtcaacagagtcacagtttcccgtacacttttggccaggggaccaggctggagagcaaaacgactgtggctgcaccatctgtcttcatcttcccg

SEQ ID NO: 538873 - DNA, 465 bp, Homo sapiens
  misc_feature: HIJSMM301DX9LD.51.53.E09.1.454.light.4.raw
cgatcgtatacacgaccggtgctcgatttagagagagtgtgttgggtttggggtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccaggaacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccaaggtggagatcaagcgaa

SEQ ID NO: 538874 - DNA, 447 bp, Homo sapiens; identical to SEQ ID NO: 535020
  misc_feature: HIJSMM301BPD3Z.18.9.A09.1.454.light.4.raw

SEQ ID NO: 538875 - DNA, 473 bp, Homo sapiens
  misc_feature: HIJSMM301DAS0F.4.75.G09.1.454.light.4.raw
agcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcactgggaccaaggtcaccgtcctaggtcagaccccg

SEQ ID NO: 538876 - DNA, 483 bp, Homo sapiens
  misc_feature: HIJSMM301BSQHG.3.77.G11.1.454.light.4.raw
agacgcactccacgaccggtgctcgatttagctagtcactcaagggaaagggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcactggtctcccaggcaggttcagtggcagtggatctgggacagaattcacgctcaccatcatcaggctgcggtctgacgacttcgcagtctatttctgtcaacagtacgatggccggctcctggacattcggccaaggtaccaaggtggacatcagacgaactgtggctgcacc

SEQ ID NO: 538877 - DNA, 490 bp, Homo sapiens; identical to SEQ ID NO: 538273
  misc_feature: HIJSMM301D7NXZ.16.73.G07.1.454.light.4.raw

SEQ ID NO: 538878 - DNA, 497 bp, Homo sapiens
  misc_feature: HIJSMM301D1HXV.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctcatgttctacggactggacaaggtcaccgtcctaggtcacgacccaagga

SEQ ID NO: 538879 - DNA, 496 bp, Homo sapiens
  misc_feature: HIJSMM301BVRXY.49.22.B11.1.454.light.4.raw
agtcgagagacacgaccggtgctcgatttagacgacagctcagggggaggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaaacctggccaggttcccaggctcctcgtctatgatgcgtccatcagggccactggcatcccagccaggttcagtggcagtggggtctgggacagacttcactctcaccatcagcagcctagagcctgaagactttgcagtttattactgtcagcagcgtagcaatttgatcaccttcggccaagggacacgactggaaattaaacgaactgtggctgcaccatctgtcttcatcttcccgcc

SEQ ID NO: 538880 - DNA, 501 bp, Homo sapiens
  misc_feature: HIJSMM301DS5TG.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtccaggtcagcccaa

SEQ ID NO: 538881 - DNA, 495 bp, Homo sapiens
  misc_feature: HIJSMM301BPAKE.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggctgggacagctccacttcccgttatgtcttcggaggtgggaccatggtcaccgtcctaggtcagcccaagaccaacccactgt

SEQ ID NO: 538882 - DNA, 441 bp, Homo sapiens; identical to SEQ ID NO: 534971
  misc_feature: HIJSMM301DI8GP.11.3.A03.1.454.light.4.raw

SEQ ID NO: 538883 - DNA, 508 bp, Homo sapiens
  misc_feature: HIJSMM301AL5QE.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacaccccctcactttcggcggaggggccgaaggtggagatcaagcgaactgtggctgcaccatctgtcttcatcttcccgcc

SEQ ID NO: 538884 - DNA, 503 bp, Homo sapiens
  misc_feature: HIJSMM301DP243.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacg

SEQ ID NO: 538885 - DNA, 514 bp, Homo sapiens
  misc_feature: HIJSMM301DS6XM.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccacctcctcg

SEQ ID NO: 538886 - DNA, 503 bp, Homo sapiens
  misc_feature: HIJSMM301ET4KQ.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcgagggaccaagctgaccgtcctgggtcagcccaaggctgccccctcggtca

SEQ ID NO: 538887 - DNA, 478 bp, Homo sapiens
  misc_feature: HIJSMM301EMNYL.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagcctccctggccatcactgggctccaggctgaggatgaggctgattattactgccagtcgtatgacagcagcctgagtgtttgggtgttcggcggaggacc

SEQ ID NO: 538888 - DNA, 483 bp, Homo sapiens
  misc_feature: HIJSMM301BUCV5.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagatttgcaacttactattgtcaacaggctaacagtttcccttaatcttcggccaagggacacgactggagattaaacgaactgtggctgcacca

SEQ ID NO: 538889 - DNA, 484 bp, Homo sapiens; identical to SEQ ID NO: 535240
  misc_feature: HIJSMM301CUOLM.47.60.F05.1.454.light.4.raw

SEQ ID NO: 538890 - DNA, 491 bp, Homo sapiens; identical to SEQ ID NO: 535194
  misc_feature: HIJSMM301AE9GH.26.78.H01.1.454.light.4.raw

SEQ ID NO: 538891 - DNA, 496 bp, Homo sapiens
  misc_feature: HIJSMM301CRVA0.43.33.C11.1.454.light.4.raw
tgtgagtagtcacgaccggtgctcgatttagagtgagctcgttgggtttgggggaagtctctctcagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtggaaatcaaacgaactagtggctgcaccatctgtcttcta

SEQ ID NO: 538892 - DNA, 479 bp, Homo sapiens
  misc_feature: HIJSMM301BORYQ.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagatttgcagtttattactgtcagcactataataactggcctccgtacagttttggccaggggaccaagctggagatcaaacgaa

SEQ ID NO: 538893 - DNA, 506 bp, Homo sapiens
  misc_feature: HIJSMM301A2JDQ.13.11.A11.1.454.light.4.raw
tcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggtaccaacagaaaccaggacagcctccgaagttactcttttactgggcgtctacccgggaatccggggtccctgaccgattcagtggcagcgggtctgggacagatttcactctcaccatcagcagccttcaggctgaagatgtggcagtttattactgtcagcaatattatatctctcctcctcggacgttcggtccaagggaccagggtggaaagtacaaacgaactagtggctgcaccatctgtcttctatcttcccgcccact

SEQ ID NO: 538894 - DNA, 447 bp, Homo sapiens; identical to SEQ ID NO: 535201
  misc_feature: HIJSMM301C68EX.18.9.A09.1.454.light.4.raw

SEQ ID NO: 538895 - DNA, 500 bp, Homo sapiens
  misc_feature: HIJSMM301ECBN8.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaatgaccgtcctaggcagcccaa

SEQ ID NO: 538896 - DNA, 497 bp, Homo sapiens
  misc_feature: HIJSMM301BMVM6.19.71.G05.1.454.light.4.raw
tactctcgtgcacgaccggtgctcgatttagtgtcgtcgcaagagagaggggggaggtacaacaggcaggcaggggcagaaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgca

SEQ ID NO: 538897 - DNA, 502 bp, Homo sapiens
  misc_feature: HIJSMM301A4YJ4.21.38.D05.1.454.light.4.raw
tcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttccccg

SEQ ID NO: 538898 - DNA, 485 bp, Homo sapiens; identical to SEQ ID NO: 536723
  misc_feature: HIJSMM301COL8Y.5.40.D07.1.454.light.4.raw

SEQ ID NO: 538899 - DNA, 516 bp, Homo sapiens
  misc_feature: HIJSMM301AX98D.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtgggagactaattttggtcatatgttgttcggcggagggaccaagctgaccgtcctcggtcagcccaaggctgccccctcggtcactctgttcccacctcct

SEQ ID NO: 538900 - DNA, 354 bp, Homo sapiens; identical to SEQ ID NO: 535026
  misc_feature: HIJSMM301BWRRT.19.22.B11.1.454.light.4.raw

SEQ ID NO: 538901 - DNA, 514 bp, Homo sapiens
  misc_feature: HIJSMM301CXM9P.51.27.C05.1.454.light.4.raw
cgatcgtatacacgaccggtgctcgatttagacgcgatcgaagggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcccccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatcaaacgaactgtggctgcaccatctgtcttcatcttcccg

SEQ ID NO: 538902 - DNA, 447 bp, Homo sapiens; identical to SEQ ID NO: 535020
  misc_feature: HIJSMM301BGNA8.18.9.A09.1.454.light.4.raw

SEQ ID NO: 538903 - DNA, 517 bp, Homo sapiens
  misc_feature: HIJSMM301B079D.41.25.C03.1.454.light.4.raw
tctatactatcacgaccggtgctcgatttagtagtgtagatttgggtttggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttcccg

SEQ ID NO: 538904 - DNA, 499 bp, Homo sapiens
  misc_feature: HIJSMM301CB4ON.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaagtcaaacgaactgtggctgcacc

SEQ ID NO: 538905 - DNA, 493 bp, Homo sapiens
  misc_feature: HIJSMM301AKVZ0.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaaggaccaaggtggagatcaaacgaactgtggctgcaccat

SEQ ID NO: 538906 - DNA, 503 bp, Homo sapiens; identical to SEQ ID NO: 536313
  misc_feature: HIJSMM301DR1I9.21.22.B11.1.454.light.4.raw

SEQ ID NO: 538907 - DNA, 504 bp, Homo sapiens
  misc_feature: HIJSMM301B46UV.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagagatcaaaggaactgtggctgcaccatctgtcttctatctttcccgccta

SEQ ID NO: 538908 - DNA, 354 bp, Homo sapiens; identical to SEQ ID NO: 535026
  misc_feature: HIJSMM301AIR8F.19.22.B11.1.454.light.4.raw

SEQ ID NO: 538909 - DNA, 439 bp, Homo sapiens
  misc_feature: HIJSMM301ES950.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagccaaggctgccccctcggtcactctgttccgccctcctcgtatctctcg

SEQ ID NO: 538910 - DNA, 487 bp, Homo sapiens; identical to SEQ ID NO: 537208
  misc_feature: HIJSMM301BZT22.3.55.E11.1.454.light.4.raw

SEQ ID NO: 538911 - DNA, 505 bp, Homo sapiens
  misc_feature: HIJSMM301BL6BI.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatacaaacgaactagtggctgcaccatctgtcttctatcttccccg

SEQ ID NO: 538912 - DNA, 491 bp, Homo sapiens
  misc_feature: HIJSMM301DOAOG.9.1.A01.1.454.light.4.raw
  modified_base (403)..(403): a, c, t, g, unknown or other
  modified_base (478)..(478): a, c, t, g, unknown or other
tgatacgtctcacgaccggtgctcgatttagacgtctcatcagggggagctgctcagttaggacccagagggaaccatggaaaccccaacgcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattacngtcagcagtatcataggtcaacacttcggcaaggacacgactggagattaaaggaactgtggctgcaccatctgnttcatcttccccg

SEQ ID NO: 538913 - DNA, 489 bp, Homo sapiens; identical to SEQ ID NO: 537426
  misc_feature: HIJSMM301DMXA6.16.72.G06.1.454.light.4.raw

SEQ ID NO: 538914 - DNA, 494 bp, Homo sapiens; identical to SEQ ID NO: 534992
  misc_feature: HIJSMM301EO12M.9.1.A01.1.454.light.4.raw

SEQ ID NO: 538915 - DNA, 502 bp, Homo sapiens
  misc_feature: HIJSMM301BVS06.48.87.H10.1.454.light.4.raw
agtatacatacacgaccggtgctcgatttagcagtactgcgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctcg

SEQ ID NO: 538916 - DNA, 493 bp, Homo sapiens
  misc_feature: HIJSMM301B721A.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaaggacacgactggagattaaacgaactgtggctgcaccatctgtctt

SEQ ID NO: 538917 - DNA, 495 bp, Homo sapiens; identical to SEQ ID NO: 535596
  misc_feature: HIJSMM301A5K8L.10.79.H02.1.454.light.4.raw

SEQ ID NO: 538918 - DNA, 486 bp, Homo sapiens
  misc_feature: HIJSMM301AXCRV.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaacgaa

SEQ ID NO: 538919 - DNA, 494 bp, Homo sapiens; identical to SEQ ID NO: 536974
  misc_feature: HIJSMM301AR3W0.16.86.H09.1.454.light.4.raw

SEQ ID NO: 538920 - DNA, 495 bp, Homo sapiens
  misc_feature: HIJSMM301BUXAK.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgtcttcattcc

SEQ ID NO: 538921 - DNA, 507 bp, Homo sapiens
  misc_feature: HIJSMM301EOFMR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaacggtaggaaatacaaacgaactagtggctgcaccatctgtcttctatcttccccg

SEQ ID NO: 538922 - DNA, 494 bp, Homo sapiens
  misc_feature: HIJSMM301A67A4.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggtccaggggaccgaacggtaggaagtcaagcgaactagtggctgcaccatctgtt

SEQ ID NO: 538923 - DNA, 500 bp, Homo sapiens
  misc_feature: HIJSMM301EF5MW.13.11.A11.1.454.light.4.raw
tcacgtactacacgaccggtgctcgatttagctacgactgcggggtaaggaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaacccactgtcactctgtt

SEQ ID NO: 538924 - DNA, 511 bp, Homo sapiens
  misc_feature: HIJSMM301AY95U.43.33.C11.1.454.light.4.raw
  modified_base (433)..(433): a, c, t, g, unknown or other
tgtgagtagtcacgaccggtgctcgatttagagtgagctcgttgggtttggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgtccgggcgagtcggcccattgacgactgtttggtcctggtatcgcgtgagaccagggcgaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctcctcccccnccctatagttcggtcgacgggacctaagttagaacatacaagtacgaacgtggtggctcgaccaacctattcttcgtt

SEQ ID NO: 538925 - DNA, 489 bp, Homo sapiens
  misc_feature: HIJSMM301DD0HH.19.71.G05.1.454.light.4.raw
  modified_base (484)..(484): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgttggacttcggccaagggaccaaggtggatatcanacgaa

SEQ ID NO: 538926 - DNA, 502 bp, Homo sapiens; identical to SEQ ID NO: 537298
  misc_feature: HIJSMM301BPI21.27.78.H01.1.454.light.4.raw

SEQ ID NO: 538927 - DNA, 490 bp, Homo sapiens
  misc_feature: HIJSMM301BSA37.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaagtaggacatcaagcgaactgtggctgcaccatct

SEQ ID NO: 538928 - DNA, 494 bp, Homo sapiens
  misc_feature: HIJSMM301EF9D0.3.78.H01.1.454.light.4.raw
agacgcactccacgaccggtgctcgatttagtgtgagtagtttgggtttggggaggaactgctcagttaggacccagagggaaccatggaagccccagcccagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagatttcgcagtttattactgtcagcagcgtagcaactggctgatcaccttcggccaagggacacgactggagattaaacgaactgtggctgcaccatctgtcttca

SEQ ID NO: 538929 - DNA, 472 bp, Homo sapiens
  misc_feature: HIJSMM301B3XCL.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaactgtgg

SEQ ID NO: 538930 - DNA, 485 bp, Homo sapiens; identical to SEQ ID NO: 536576
  misc_feature: HIJSMM301BB10W.46.35.D02.1.454.light.4.raw

SEQ ID NO: 538931 - DNA, 497 bp, Homo sapiens
  misc_feature: HIJSMM301DCEK5.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatattgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatcaaacgaactgtggctgcac

SEQ ID NO: 538932 - DNA, 495 bp, Homo sapiens; identical to SEQ ID NO: 536055
  misc_feature: HIJSMM301DW1K5.47.38.D05.1.454.light.4.raw

SEQ ID NO: 538933 - DNA, 474 bp, Homo sapiens; identical to SEQ ID NO: 537034
  misc_feature: HIJSMM301ALUWP.5.15.B04.1.454.light.4.raw

SEQ ID NO: 538934 - DNA, 488 bp, Homo sapiens
  misc_feature: HIJSMM301A43UC.52.13.B02.1.454.light.4.raw
cgcagtacgacacgaccggtgctcgatttagtctagcgacttccgcggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccaggagtgatattggtggtcataactatgtctcctggtaccagcagctcccaggcaaagcccccaaactcatgatttttgatgtcaataagcggccctcaggggtccctgatcgcttctctggctccaagtctggcaacacggcctccctgaccatctctgggctccaggctgaggatgaggctgattattactgctgttcatttgcaggcatgtacacttatgtcttcggaagtgggaccagcgtcaccgtcctaagtcagcccaac

SEQ ID NO: 538935 - DNA, 498 bp, Homo sapiens
  misc_feature: HIJSMM301ALZT2.9.1.A01.1.454.light.4.raw
tgatacgtctcacgaccggtgctcgatttagacgtctcatcagggggagctgctcagttaggacccagagggaaccatacggaaaccccagcgcagcttctcttcctcctgctactctggctcccagataccaccggagaaattgtgttgacgcagtctccgggcaccctgtctttctctccgaggggagagagccaccctctcctgcaggaccagtcagagtgttaccagcaactacttggcctggtaccagcagaaatctggccagcctcccaggctcctcatctatggtgaatccaacagggccactggcatcccagacaggttcaggtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 538936 - DNA, 518 bp, Homo sapiens
  misc_feature: HIJSMM301AN5AJ.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagtattccttttactttcggtcccgtccgggtacgaaaacgtaggtagtaatctaaaccgaaactagttggcgtgcgaccaactacttcg

SEQ ID NO: 538937 - DNA, 489 bp, Homo sapiens
  misc_feature: HIJSMM301E4AHP.26.30.C08.1.454.light.4.raw
agactatactcacgaccggtgctcgatttagtctgacgtcaaagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactagtcagcagtatcatgactggccgcctcaccctcgtccgaacggaacgacgaacgtgagagttaacgaaacgtaagtaggt

SEQ ID NO: 538938 - DNA, 517 bp, Homo sapiens
  misc_feature: HIJSMM301EM64X.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccg

SEQ ID NO: 538939 - DNA, 489 bp, Homo sapiens
  misc_feature: HIJSMM301CJC1G.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggagggaccaaggcggagatcagacgactgtggctgcaccatctgtcttcta

SEQ ID NO: 538940 - DNA, 504 bp, Homo sapiens
  misc_feature: HIJSMM301CH4SA.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtcta

SEQ ID NO: 538941 - DNA, 487 bp, Homo sapiens
  misc_feature: HIJSMM301B7F7L.12.31.C09.1.454.light.4.raw
  modified_base (485)..(485): a, c, t, g, unknown or other
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagagttaccgcgctcccatcactttcggccaagggcacgaccgcagattggacgaactgtggctgcncc

SEQ ID NO: 538942 - DNA, 495 bp, Homo sapiens
  misc_feature: HIJSMM301ESNI4.43.61.F06.1.454.light.4.raw
tgtgagtagtcacgaccggtgctcgatttagctacgctctaagggaaagggggaagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtacacttttggccaggggaccaagctagaaatcaaacgaactgtggctgcaccatctgtctt

SEQ ID NO: 538943 - DNA, 485 bp, Homo sapiens
  misc_feature: HIJSMM301DMFWS.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgataactacttagcctggttgcagcacaaacctggccaggctcccaggctcctcatctatgctgcatccatcagggccactggcatcccaggcagattcagtggcagtgggtctgggacagacttcactctcaccatcagcagactggagcctgagattttgcagtctattactgtcagcagtatggtcacgtcccaagaacttttggccaggggaccaagctggagatcaaacgaactgtggctgcaccat

SEQ ID NO: 538944 - DNA, 492 bp, Homo sapiens
  misc_feature: HIJSMM301C5AS3.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagtggcctgcagtctgaagattttgcagtttattactgtcagcagtataatgacttgggtttattcactttcggccctgggaccaaagtggatttcagacgaactgtggctgcaccatctgtcttcta

SEQ ID NO: 538945 - DNA, 441 bp, Homo sapiens; identical to SEQ ID NO: 534971
  misc_feature: HIJSMM301CUX3S.11.3.A03.1.454.light.4.raw

SEQ ID NO: 538946 - DNA, 495 bp, Homo sapiens
  misc_feature: HIJSMM301AGUFF.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctctacttcggtcggagggacgaacgaggagatcagacgaactagtggcgtcgcaccactctcgtcttcta

SEQ ID NO: 538947 - DNA, 444 bp, Homo sapiens; identical to SEQ ID NO: 535027
  misc_feature: HIJSMM301EE1EQ.8.73.G07.1.454.light.4.raw

SEQ ID NO: 538948 - DNA, 361 bp, Homo sapiens
  misc_feature: HIJSMM301BL25B.3.57.F02.1.454.light.4.raw
agacgcactccacgaccggtgctcgatttagctcgatatagttgggtttgggggtgtggtggtctccactcccgccttgacggggctgctatctgccttccaggcccttatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggtcttcggcggcgggaccaagctgaccgtcctatgtcaacccaaggctggcccctcggtcactctgttcccgccctcctcgagtgcgtct

SEQ ID NO: 538949 - DNA, 495 bp, Homo sapiens; identical to SEQ ID NO: 535964
  misc_feature: HIJSMM301CT1YV.16.10.A10.1.454.light.4.raw

SEQ ID NO: 538950 - DNA, 507 bp, Homo sapiens
  misc_feature: HIJSMM301BW37L.51.38.D05.1.454.light.4.raw
cgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctcctgaccatctctggcctccaggccgaggacgaggctgattattactgcagctcatatacaatcaataacaattgggtgttcggcggagggaccaaactgaccgtcctaggtcagcccaaggctgcccctcggtcact

SEQ ID NO: 538951 - DNA, 489 bp, Homo sapiens; identical to SEQ ID NO: 536663
  misc_feature: HIJSMM301AOSON.16.72.G06.1.454.light.4.raw

SEQ ID NO: 538952 - DNA, 501 bp, Homo sapiens
  misc_feature: HIJSMM301AQMAO.12.48.E04.1.454.light.4.raw
atacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggatgttcggcggagggaccaagctgaccgtcctaggtcagcccaa

SEQ ID NO: 538953 - DNA, 502 bp, Homo sapiens
  misc_feature: HIJSMM301CNIUQ.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggtcggagggaccgaaggtggaggatcaaacgaactgtggctgcaccatctgtcttcatcttccccg

SEQ ID NO: 538954 - DNA, 485 bp, Homo sapiens
  misc_feature: HIJSMM301CFKAV.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactgtggctgcaccatct

SEQ ID NO: 538955 - DNA, 510 bp, Homo sapiens
  misc_feature: HIJSMM301BSBGH.16.1.A01.1.454.light.4.raw
tgtactactccacgaccggtgctcgatttagacgtctcatcaggagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagccccaaactcactcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggtagggaccaagctgaccgtcctaggtcagcccaaggctgccccctcggtcactctccg

SEQ ID NO: 538956 - DNA, 485 bp, Homo sapiens
  misc_feature: HIJSMM301CPG9M.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgcagtttattcctgtcagcagtacaatgactggccgtacacttttggccaggggaccaagctggagatcaaacgaactgtggctgcacc

SEQ ID NO: 538957 - DNA, 500 bp, Homo sapiens
  misc_feature: HIJSMM301DFD7O.13.11.A11.1.454.light.4.raw
tcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctgtt

SEQ ID NO: 538958 - DNA, 447 bp, Homo sapiens; identical to SEQ ID NO: 535020
  misc_feature: HIJSMM301ASFZS.18.9.A09.1.454.light.4.raw

SEQ ID NO: 538959 - DNA, 463 bp, Homo sapiens; identical to SEQ ID NO: 535062
  misc_feature: HIJSMM301BZ059.11.73.G07.1.454.light.4.raw

SEQ ID NO: 538960 - DNA, 485 bp, Homo sapiens; identical to SEQ ID NO: 536630
  misc_feature: HIJSMM301EHEM0.13.56.F01.1.454.light.4.raw

SEQ ID NO: 538961 - DNA, 501 bp, Homo sapiens; identical to SEQ ID NO: 536818
  misc_feature: HIJSMM301B58CE.12.82.H05.1.454.light.4.raw

SEQ ID NO: 538962 - DNA, 513 bp, Homo sapiens
  misc_feature: HIJSMM301AJNMX.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggtcggagggaccgaaggtggaccgtcaaaccgaactacgtggctgcaccatctgtcttctatcttcccgccc

SEQ ID NO: 538963 - DNA, 496 bp, Homo sapiens; identical to SEQ ID NO: 535556
  misc_feature: HIJSMM301DEJH5.26.80.H03.1.454.light.4.raw

SEQ ID NO: 538964 - DNA, 482 bp, Homo sapiens
  misc_feature: HIJSMM301AMO90.49.27.C05.1.454.light.4.raw
agtcgagagacacgaccggtgctcgatttagacgcgatcgaagggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaacggtggaggatcaagcgaactgttggcgtgcaccta

SEQ ID NO: 538965 - DNA, 465 bp, Homo sapiens
  misc_feature: HIJSMM301EPYNB.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatacaaacgaaactgtggctgcaccatctgtcttcatcttcccgccatctgatcgtagcact

SEQ ID NO: 538966 - DNA, 485 bp, Homo sapiens; identical to SEQ ID NO: 535018
  misc_feature: HIJSMM301EW7X9.46.35.D02.1.454.light.4.raw

SEQ ID NO: 538967 - DNA, 486 bp, Homo sapiens
  misc_feature: HIJSMM301BJ29N.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaaggggacacggactggagattaaacgaactgtggctgcaccat

SEQ ID NO: 538968 - DNA, 500 bp, Homo sapiens
  misc_feature: HIJSMM301E1YJO.4.71.G05.1.454.light.4.raw
agcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacaagtgataatttctgggtgttcggcggagggaccaaactagacgtcctaggtcagccaaggctgccccctccggtcactc

SEQ ID NO: 538969 - DNA, 516 bp, Homo sapiens
  misc_feature: HIJSMM301DGDRP.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctgttcccacctcctccacg

SEQ ID NO: 538970 - DNA, 487 bp, Homo sapiens; identical to SEQ ID NO: 535863
  misc_feature: HIJSMM301AXJ9O.19.71.G05.1.454.light.4.raw

SEQ ID NO: 538971 - DNA, 487 bp, Homo sapiens; identical to SEQ ID NO: 537009
  misc_feature: HIJSMM301BRCSI.12.88.H11.1.454.light.4.raw

SEQ ID NO: 538972 - DNA, 454 bp, Homo sapiens; identical to SEQ ID NO: 534964
  misc_feature: HIJSMM301BHYU6.19.86.H09.1.454.light.4.raw

SEQ ID NO: 538973 - DNA, 503 bp, Homo sapiens
  misc_feature: HIJSMM301B17HG.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtca

SEQ ID NO: 538974 - DNA, 496 bp, Homo sapiens
  misc_feature: HIJSMM301BU4Z0.3.78.H01.1.454.light.4.raw
agacgcactccacgaccggtgctcgatttagtgtgagtagtttgggtttggggaggaactgctcagttaggacccacgagggaaccatggaagccccacgcccagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagatttcgcagtttattactgtcagcagcgtagcaactggctgatcaccttcggccaagggacacgactggagattaaacgaactgtggctgcaccatctgtcttca

SEQ ID NO: 538975 - DNA, 504 bp, Homo sapiens
  misc_feature: HIJSMM301COSWB.49.73.G07.1.454.light.4.raw
agtcgagagacacgaccggtgctcgatttagctctacgctctaaggggctggcctaaggaagcagcactggtggtgcctcagccatggcctggaccgttctcctcctcggcctcctctctcactgcacagtctctgtgacctcctatgtgctgtctcagtcaccctcggtgtcagtggccccaggacagacggccaggattacctgtgggggagacaacattggaaataaaggtgtgcactggtaccagcagatgccaggccaggcccctgtcctggtcgtctttgatgatagcgaccggccctcagggatccctgagcgattctctggctccaactctggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccg

SEQ ID NO: 538976 - DNA, 478 bp, Homo sapiens
  misc_feature: HIJSMM301DOOHE.13.73.G07.1.454.light.4.raw
tcacgtactacacgaccggtgctcgatttagctctacgctcagggggatcaggactcctcagttcatcttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccagggaccaagctggagatcaatcgaa

SEQ ID NO: 538977 - DNA, 504 bp, Homo sapiens
  misc_feature: HIJSMM301BSQL5.48.37.D04.1.454.light.4.raw
agtatacatacacgaccggtgctcgatttagtagcatactgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 538978 - DNA, 494 bp, Homo sapiens
  misc_feature: HIJSMM301BMO06.51.45.E01.1.454.light.4.raw
cgatcgtatacacgaccggtgctcgatttagtgagtcagtaagggaaagggtgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaaatcaacagagtggaggctgaggatgttggggtttattactgcgtgcaaagtctgcaaactatcaccttcggccaagggacacgactggagattaaacgaactgtggctgcacca

SEQ ID NO: 538979 - DNA, 506 bp, Homo sapiens; identical to SEQ ID NO: 535058
  misc_feature: HIJSMM301EKBHI.17.41.D08.1.454.light.4.raw

SEQ ID NO: 538980 - DNA, 498 bp, Homo sapiens
  misc_feature: HIJSMM301A4AWG.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattatacttcgtggacgttcggccaagggaccaaggtggataatcagacgaactagtggctg

SEQ ID NO: 538981 - DNA, 480 bp, Homo sapiens; identical to SEQ ID NO: 535291
  misc_feature: HIJSMM301A15PS.22.59.F04.1.454.light.4.raw

SEQ ID NO: 538982 - DNA, 517 bp, Homo sapiens
  misc_feature: HIJSMM301CZHKW.49.9.A09.1.454.light.4.raw
agtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgcctcctctctctcg

SEQ ID NO: 538983 - DNA, 504 bp, Homo sapiens
  misc_feature: HIJSMM301AN9FR.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctggggacagacttcactctcaccatcatcagcctggagcctgaagatgttgcagtttattactgtcaacatcgtaccgagtggcctccgggggccacttcggccctgggaccaaagtggatatcaacgaactgtggctgcaccatctgtctt

SEQ ID NO: 538984 - DNA, 481 bp, Homo sapiens; identical to SEQ ID NO: 535410
  misc_feature: HIJSMM301D1X4X.41.68.G02.1.454.light.4.raw

SEQ ID NO: 538985 - DNA, 493 bp, Homo sapiens; identical to SEQ ID NO: 535047
  misc_feature: HIJSMM301AT6F3.16.53.E09.1.454.light.4.raw

SEQ ID NO: 538986 - DNA, 504 bp, Homo sapiens
  misc_feature: HIJSMM301A5AYW.43.24.C02.1.454.light.4.raw
tgtgagtagtcacgaccggtgctcgatttagtacagatcgttagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccca

SEQ ID NO: 538987 - DNA, 508 bp, Homo sapiens
  misc_feature: HIJSMM301C0ZQZ.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgtt

SEQ ID NO: 538988 - DNA, 488 bp, Homo sapiens
  misc_feature: HIJSMM301C0YV9.3.38.D05.1.454.light.4.raw
  modified_base (466)..(466): a, c, t, g, unknown or other
  modified_base (479)..(479): a, c, t, g, unknown or other
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactaactgtcaacagaagtttcactaccctcctcacttcggtcggggacggaacggaggaggatanaaacaacaagtgngtcgcacca

SEQ ID NO: 538989 - DNA, 494 bp, Homo sapiens
  misc_feature: HIJSMM301AOMOE.13.48.E04.1.454.light.4.raw
  modified_base (468)..(468): a, c, t, g, unknown or other
  modified_base (479)..(479): a, c, t, g, unknown or other
  modified_base (484)..(484): a, c, t, g, unknown or other
tcacgtactacacgaccggtgctcgatttagagagcgtcacagagagaagggggcaggagtcagacccactcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtcacggacaacgtaggaagtacaagnacatggctgcnccacnctgtcttcta

SEQ ID NO: 538990 - DNA, 492 bp, Homo sapiens; identical to SEQ ID NO: 536010
  misc_feature: HIJSMM301AG4XI.10.20.B09.1.454.light.4.raw

SEQ ID NO: 538991 - DNA, 494 bp, Homo sapiens
  misc_feature: HIJSMM301A8SNY.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaaggaccgaaggtggaaggtcaaacgaactagtggcgtgcaccatctgtctt

SEQ ID NO: 538992 - DNA, 489 bp, Homo sapiens
  misc_feature: HIJSMM301DLFSS.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcggccaagggaccaaggtggaaatcaaacgaactgtggctgcaccatctgtcttcta

SEQ ID NO: 538993 - DNA, 479 bp, Homo sapiens
  misc_feature: HIJSMM301DQRXW.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccggtcctaagtcagcccg

SEQ ID NO: 538994 - DNA, 475 bp, Homo sapiens; identical to SEQ ID NO: 537726
  misc_feature: HIJSMM301EHEZS.12.1.A01.1.454.light.4.raw

SEQ ID NO: 538995 - DNA, 383 bp, Homo sapiens
  misc_feature: HIJSMM301BN813.41.55.E11.1.454.light.4.raw
tctatactatcacgaccggtgctcgatttagcactcgcacgttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 538996 - DNA, 498 bp, Homo sapiens
  misc_feature: HIJSMM301AG742.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccagggaccaagctggagatcaaacgaactgtggctgcaccatctgtcttcat

SEQ ID NO: 538997 - DNA, 486 bp, Homo sapiens
  misc_feature: HIJSMM301A0GW8.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggtcaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaacgaactgtggctgcaccat

SEQ ID NO: 538998 - DNA, 486 bp, Homo sapiens; identical to SEQ ID NO: 535481
  misc_feature: HIJSMM301CUFES.17.21.B10.1.454.light.4.raw

SEQ ID NO: 538999 - DNA, 490 bp, Homo sapiens
  misc_feature: HIJSMM301BSHU0.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagccc

SEQ ID NO: 539000 - DNA, 484 bp, Homo sapiens
  misc_feature: HIJSMM301A02CA.43.33.C11.1.454.light.4.raw
  modified_base (459)..(459): a, c, t, g, unknown or other
  modified_base (462)..(462): a, c, t, g, unknown or other
tgtgagtagtcacgaccggtgctcgatttagagtgagctcgttgggtttggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctccccctactattcgtcgaggacgactaganatnatacgaactgtggctgcaccta

SEQ ID NO: 539001 - DNA, 494 bp, Homo sapiens; identical to SEQ ID NO: 534992
  misc_feature: HIJSMM301A6QR9.9.1.A01.1.454.light.4.raw

SEQ ID NO: 539002 - DNA, 502 bp, Homo sapiens
  misc_feature: HIJSMM301CEXRC.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccc

SEQ ID NO: 539003 - DNA, 484 bp, Homo sapiens
  misc_feature: HIJSMM301BN0TB.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtcagacccg

SEQ ID NO: 539004 - DNA, 506 bp, Homo sapiens
  misc_feature: HIJSMM301BE74X.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaatagaacgtggtcggtctcgaccacctatcttcg

SEQ ID NO: 539005 - DNA, 382 bp, Homo sapiens
  misc_feature: HIJSMM301ECX00.41.25.C03.1.454.light.4.raw
tctatactatcacgaccggtgctcgatttagtagtgtagatttgggtttggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 539006 - DNA, 494 bp, Homo sapiens
  misc_feature: HIJSMM301ALNNL.48.1.A01.1.454.light.4.raw
agtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcatcttcccg

SEQ ID NO: 539007 - DNA, 510 bp, Homo sapiens
  misc_feature: HIJSMM301BNJ2F.16.46.E02.1.454.light.4.raw
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctcg

SEQ ID NO: 539008 - DNA, 513 bp, Homo sapiens
  misc_feature: HIJSMM301DHN7K.17.37.D04.1.454.light.4.raw
cgtagactagcacgaccggtgctcgatttagtagcatactgttgggtttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaactgtgcactggtaccagcagaagccaggccaggcccctgtgctggtcgtctatgatgataccgaccggccctcagggatcccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtccttggtcagcccaaggctgccccctcggtcactctgttcccg

SEQ ID NO: 539009 - DNA, 494 bp, Homo sapiens; identical to SEQ ID NO: 536444
  misc_feature: HIJSMM301AXKUI.26.72.G06.1.454.light.4.raw

SEQ ID NO: 539010 - DNA, 492 bp, Homo sapiens
  misc_feature: HIJSMM301ELI0Q.17.43.D10.1.454.light.4.raw
cgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtgcttccaccagggccgctggtgtcccagccagattcaggggcagtgggtctgggacagagttcactctcaccatcagcagcctgcagtctgaagattttgcagtttattactgtcagcactataataactggcccccgggggagttcggccaaggaccgaaggtggagatcaaacgaactgtggctgcaccatctgtcttcat

SEQ ID NO: 539011 - DNA, 491 bp, Homo sapiens; identical to SEQ ID NO: 536211
  misc_feature: HIJSMM301EII2E.16.53.E09.1.454.light.4.raw

SEQ ID NO: 539012 - DNA, 500 bp, Homo sapiens
  misc_feature: HIJSMM301AKXUE.48.36.D03.1.454.light.4.raw
agtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaacccca

SEQ ID NO: 539013 - DNA, 501 bp, Homo sapiens; identical to SEQ ID NO: 535746
  misc_feature: HIJSMM301EE4BA.18.11.A11.1.454.light.4.raw

SEQ ID NO: 539014 - DNA, 487 bp, Homo sapiens
  misc_feature: HIJSMM301CVSRM.52.3.A03.1.454.light.4.raw
cgcagtacgacacgaccggtgctcgatttagagagcgtcacagggggagtcagacccagtcaggacacagcatggacatgagggtccccgctcagctcctggggctcctgctgctctggctcccaggtgccaaatgtgacatccagatgacccagtctccttccaccctgtctgcatctgttggagacagagtcaccatctcttgccgggccagtcagagtattagtacctcgttggcctggtatcagaagaaaccagggaaagcccctaaactcctgatctctaaggcatctgatttacaaactggggtcccgtcaaggttcagcggcagtggatctgggacagacttcactctcaccatcagcagcctgcagcctgatgactttgcaagttattattgccaacagtataacagtttttcattcacttttggccctgggacgacagtggatatcaaacgaactgtggctgcaccatctgtcttcta

SEQ ID NO: 539015 - DNA, 493 bp, Homo sapiens
  misc_feature: HIJSMM301DOID2.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaacgaactgtggctgcaccatctgtctt

SEQ ID NO: 539016 - DNA, 476 bp, Homo sapiens
  misc_feature: HIJSMM301AJZZQ.51.67.G01.1.454.light.4.raw
cgatcgtatacacgaccggtgctcgatttagagtatacatattgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgccaacagtatgatagtctcccgctcactttcggcggggggaccgaaggtggagatcaagcgaacagtgg

SEQ ID NO: 539017 - DNA, 508 bp, Homo sapiens
  misc_feature: HIJSMM301D0Z7S.22.65.F10.1.454.light.4.raw
  modified_base (424)..(424): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccncgactcctaccgtcgacgaacggacaacgcgtaggaagtaaactaaaccgatggcgtcgtcgaccactcttcgtcttcctactt

SEQ ID NO: 539018 - DNA, 505 bp, Homo sapiens
  misc_feature: HIJSMM301BQSAN.41.45.E01.1.454.light.4.raw
tctatactatcacgaccggtgctcgatttagtgagtcagtaagggaaaggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctacggtcagcccaaggctcgccccctccggtcactcttcg

SEQ ID NO: 539019 - DNA, 492 bp, Homo sapiens
  misc_feature: HIJSMM301CKZUN.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaggaactgtggctgcaccatctgtcttcatcttcccg

SEQ ID NO: 539020 - DNA, 454 bp, Homo sapiens; identical to SEQ ID NO: 534964
  misc_feature: HIJSMM301AMRE3.19.86.H09.1.454.light.4.raw

SEQ ID NO: 539021 - DNA, 488 bp, Homo sapiens
  misc_feature: HIJSMM301DSBE5.21.4.A04.1.454.light.4.raw
tcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaagggaccaaggtataaatgaaacgaactgtggctgcaccat

SEQ ID NO: 539022 - DNA, 494 bp, Homo sapiens
  misc_feature: HIJSMM301AM45X.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgtacccccaccctacggttcggcggacggaccacgacgtcgagactacaaacgtactggtggctcgaccacc

SEQ ID NO: 539023 - DNA, 500 bp, Homo sapiens
  misc_feature: HIJSMM301AJ96C.43.33.C11.1.454.light.4.raw
  modified_base (465)..(465): a, c, t, g, unknown or other
tgtgagtagtcacgaccggtgctcgatttagagtgagctcgttgggtttgggcggtgctcgatttagagtgagctcgttgggtttggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagattttcttctcgtcatcactggtctacagtctgacgacggcgcaatgtacttctgtcaacactatgcctcctccccnccctactacgtttcggcgacgggaccaagtagaac

SEQ ID NO: 539024 - DNA, 481 bp, Homo sapiens; identical to SEQ ID NO: 536255
  misc_feature: HIJSMM301DDN0V.10.53.E09.1.454.light.4.raw

SEQ ID NO: 539025 - DNA, 484 bp, Homo sapiens; identical to SEQ ID NO: 535400
  misc_feature: HIJSMM301D82Z5.46.26.C04.1.454.light.4.raw

SEQ ID NO: 539026 - DNA, 502 bp, Homo sapiens
  misc_feature: HIJSMM301BRRD9.10.44.D11.1.454.light.4.raw
catagtagtgcacgaccggtgctcgatttagcgcagtacgaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaagtggatatcaaacgaactagtggctgcaccatctgtcttcatt

SEQ ID NO: 539027 - DNA, 419 bp, Homo sapiens
  misc_feature: HIJSMM301BZP2T.10.39.D06.1.454.light.4.raw
catagtagtgcacgaccggtgctcgatttagtgacatctcgcagttctttgggggagagactgaagaacccagcattgcagcagctccaccatggcctgggctcctctgctcctcaccctcctcagtctcctcacagggttgactcagccaccttctgcatcagcctccctgggagcctcggtcacactcacctgcaccctgaacagcgactacatcttgggctcaggcctcaatcggtgcctgaccaccaacaacatctacgaagagggtgagagtgtccctcactgtggggcagacaatggcagtgggagcaatttcgtgagagtgttcggcggagggaccaacctgaccgtccttcctaggtcagcccaaggctgccccctcggtcactctgttcccaccctcctccactactatg

SEQ ID NO: 539028 - DNA, 503 bp, Homo sapiens
  misc_feature: HIJSMM301BM0XS.2.76.G10.1.454.light.4.raw
  modified_base (449)..(449): a, c, t, g, unknown or other
  modified_base (492)..(492): a, c, t, g, unknown or other
acgctcgacacacgaccggtgctcgatttagtcactcatacagggggagagatctggggaaggctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatnaccaacctgggtgcttatctcttcggacctgggaccaaggtcnccgtccttggt

SEQ ID NO: 539029 - DNA, 445 bp, Homo sapiens; identical to SEQ ID NO: 537719
  misc_feature: HIJSMM301BRMMV.47.85.H08.1.454.light.4.raw

SEQ ID NO: 539030 - DNA, 385 bp, Homo sapiens
  misc_feature: HIJSMM301BTD5R.49.34.D01.1.454.light.4.raw
agtcgagagacacgaccggtgctcgatttagatcgtctgtgttgggtttggggtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 539031 - DNA, 495 bp, Homo sapiens; identical to SEQ ID NO: 535486
  misc_feature: HIJSMM301CY552.26.72.G06.1.454.light.4.raw

SEQ ID NO: 539032 - DNA, 504 bp, Homo sapiens
  misc_feature: HIJSMM301BO9ZU.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttcttatcctccgtggacgttcggccaagggaccagggtggaaatcagacgaactgtggctgcaccat

SEQ ID NO: 539033 - DNA, 505 bp, Homo sapiens
  misc_feature: HIJSMM301CTLXJ.22.21.B10.1.454.light.4.raw
acatacgcgtcacgaccggtgctcgatttagtgtcgtcgcaagggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtcactctcg

SEQ ID NO: 539034 - DNA, 475 bp, Homo sapiens
  misc_feature: HIJSMM301EBU66.47.48.E04.1.454.light.4.raw
agctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaaggaccgaacggtggaaatacaacgaactgtgg

SEQ ID NO: 539035 - DNA, 488 bp, Homo sapiens; identical to SEQ ID NO: 537673
  misc_feature: HIJSMM301ANP13.12.31.C09.1.454.light.4.raw

SEQ ID NO: 539036 - DNA, 488 bp, Homo sapiens; identical to SEQ ID NO: 537055
  misc_feature: HIJSMM301CXJ1J.4.64.F09.1.454.light.4.raw

SEQ ID NO: 539037 - DNA, 445 bp, Homo sapiens
  misc_feature: HIJSMM301DX9XG.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcagggtcgtctgaccgattctctgcctccaagtctggcacttctgcctccctggtcatatctggtctccagggtgaggatgaggctgattatttactgccactcctatgacaacagcctgagtatttggctgttcggcggcgggaccaagttgaccgtcctacgtcagcccaaggctgccccctcggtcactctgttcccaccctcctccactactatg

SEQ ID NO: 539038 - DNA, 492 bp, Homo sapiens
  misc_feature: HIJSMM301AUWDS.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgtcgccaaggaccaaggtaggagtcaaacgaactagtggctgcaccatctgtcttcatcttcccg

SEQ ID NO: 539039 - DNA, 497 bp, Homo sapiens; identical to SEQ ID NO: 536371
  misc_feature: HIJSMM301DVVRH.16.78.H01.1.454.light.4.raw

SEQ ID NO: 539040 - DNA, 444 bp, Homo sapiens; identical to SEQ ID NO: 535856
  misc_feature: HIJSMM301CVU6J.9.9.A09.1.454.light.4.raw

SEQ ID NO: 539041 - DNA, 485 bp, Homo sapiens
  misc_feature: HIJSMM301A9IMA.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggaccaaggtggagatcaaacgaac

SEQ ID NO: 539042 - DNA, 476 bp, Homo sapiens; identical to SEQ ID NO: 538026
  misc_feature: HIJSMM301AECQ5.13.76.G10.1.454.light.4.raw

SEQ ID NO: 539043 - DNA, 475 bp, Homo sapiens
  misc_feature: HIJSMM301A7AUP.13.76.G10.1.454.light.4.raw
tcacgtactacacgaccggtgctcgatttagtcactcatacaggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccc

SEQ ID NO: 539044 - DNA, 490 bp, Homo sapiens
  misc_feature: HIJSMM301EE8F4.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcggccaagggaccaaggtggaaagtcaaacgaactgtggctgcaccatctgtcttcta

SEQ ID NO: 539045 - DNA, 444 bp, Homo sapiens; identical to SEQ ID NO: 535856
  misc_feature: HIJSMM301D9VNA.9.9.A09.1.454.light.4.raw

SEQ ID NO: 539046 - DNA, 485 bp, Homo sapiens; identical to SEQ ID NO: 535880
  misc_feature: HIJSMM301DCQ4L.7.75.G09.1.454.light.4.raw

SEQ ID NO: 539047 - DNA, 493 bp, Homo sapiens; identical to SEQ ID NO: 535047
  misc_feature: HIJSMM301DL8EB.16.53.E09.1.454.light.4.raw

SEQ ID NO: 539048 - DNA, 527 bp, Homo sapiens
  misc_feature: HIJSMM301BVFNA.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgacggaccgaacggtaggaaggtacgaaacgaacacggtgcgtgcgaccactctgtcgttctactcttcccgtcccactcctcgtat

SEQ ID NO: 539049 - DNA, 506 bp, Homo sapiens
  misc_feature: HIJSMM301BU28H.17.41.D08.1.454.light.4.raw
  modified_base (241)..(241): a, c, t, g, unknown or other
cgtagactagcacgaccggtgctcgatttagtcacgcgagaaagggaaaggggagagctgctcagttaggacccagagggaaccatggaaaccccagcgcagcttctcttcctcctgctactctggctcccagatacccaccggagaaattgtgttgacgcagtctccaggcaccctgtccttgtctccaggggaaacagccaccctctcctgtagggccagtcagagtgttttaaaactntttagcctggtaccaacagaagcctggccaggctcccaggctcctcatctatggtgcatccaccagggccactggcatcccagacagggttcagtggcggtgggtctggggacagaattcactctcaccatcaccagtctggagcctgaagattttgctctgtatcactgtcagcaatatggtggtacaccctcactttcggcggagggccaaggtggagatcaagcgaactgtggctgcaccatctgtcttcatcttcccgcat

SEQ ID NO: 539050 - DNA, 479 bp, Homo sapiens; identical to SEQ ID NO: 536050
  misc_feature: HIJSMM301AE9EP.5.73.G07.1.454.light.4.raw

SEQ ID NO: 539051 - DNA, 508 bp, Homo sapiens
  misc_feature: HIJSMM301CVKOJ.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccta

SEQ ID NO: 539052 - DNA, 490 bp, Homo sapiens; identical to SEQ ID NO: 537951
  misc_feature: HIJSMM301AZ7MH.19.57.F02.1.454.light.4.raw

SEQ ID NO: 539053 - DNA, 461 bp, Homo sapiens
  misc_feature: HIJSMM301BFNR6.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcgggagggaccaggctgaccgtcctaggtcagcccaaggctgccccctcggtcactctgttcccaccctcctcacgcgtatgt

SEQ ID NO: 539054 - DNA, 491 bp, Homo sapiens; identical to SEQ ID NO: 535194
  misc_feature: HIJSMM301DEMH4.26.78.H01.1.454.light.4.raw

SEQ ID NO: 539055 - DNA, 475 bp, Homo sapiens
  misc_feature: HIJSMM301DB9C9.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtacaacagagttacagtaccccgtggacgttcggccaagggaccaaggtaggaaatacaaacgaactgtgg

SEQ ID NO: 539056 - DNA, 506 bp, Homo sapiens
  misc_feature: HIJSMM301CK38K.52.69.G03.1.454.light.4.raw
cgcagtacgacacgaccggtgctcgatttagtcgctgcgtaaaggagaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaggcggctccaacatcggagggaatactgtgaactggtaccagcaactcccagggacggcccccagactcctcatctttagtcataatcagcggccctcaggggtccctgaccgattctctggctccaagtctggcacctcagcctccttggccatcagtgggctccagtctgacgatgaggctgattacttctgtgcaacttgggatgacagcctgaatggtccggtgttcggcggagggaccaagcttaccgttctgggtcagcccaaggctcg

SEQ ID NO: 539057 - DNA, 486 bp, Homo sapiens
  misc_feature: HIJSMM301BKWLD.47.70.G04.1.454.light.4.raw
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccagggaccaaactggacatcaaacgaactgtggctgcaccatctgtt

SEQ ID NO: 539058 - DNA, 497 bp, Homo sapiens
  misc_feature: HIJSMM301B955H.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccactgt

SEQ ID NO: 539059 - DNA, 519 bp, Homo sapiens
  misc_feature: HIJSMM301CBLB4.41.18.B07.1.454.light.4.raw
tctatactatcacgaccggtgctcgatttagtcgctgcgtaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtggttcggcgggggacggaaccgagtcgtaccggtacccgttacgtcgacgaccgaacccgacggtcgtcccccgcccccggtcggt

SEQ ID NO: 539060 - DNA, 485 bp, Homo sapiens
  misc_feature: HIJSMM301EH45M.3.55.E11.1.454.light.4.raw
agacgcactccacgaccggtgctcgatttagcactcgcacgttgggtttgggggaggaactgctcagttaggacccagacgtaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactgtggctgcaccatct

SEQ ID NO: 539061 - DNA, 495 bp, Homo sapiens
  misc_feature: HIJSMM301CITD6.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtgctgcacc

SEQ ID NO: 539062 - DNA, 511 bp, Homo sapiens
  misc_feature: HIJSMM301BP9KN.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcattttgggtgttcggcggagggaccaaactgaccgtcctaggtcagcccaaggctgccccctcggtcact

SEQ ID NO: 539063 - DNA, 515 bp, Homo sapiens
  misc_feature: HIJSMM301A46EK.51.33.C11.1.454.light.4.raw
cgatcgtatacacgaccggtgctcgatttagagtgagctcgttgggtttgggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccgaaggtaggaaagtacaaacgaaactagtggctgcaccatctgtctt

SEQ ID NO: 539064 - DNA, 493 bp, Homo sapiens; identical to SEQ ID NO: 537281
  misc_feature: HIJSMM301A5AXO.9.1.A01.1.454.light.4.raw

SEQ ID NO: 539065 - DNA, 494 bp, Homo sapiens
  misc_feature: HIJSMM301CTZ7Q.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttactgtcagcagtatagtaactggcctccgtacacttttggccaggggaccaagctagaaatcaaacgaactgtggctgcaccatctgtcttcta

SEQ ID NO: 539066 - DNA, 498 bp, Homo sapiens
  misc_feature: HIJSMM301BNZH0.48.44.D11.1.454.light.4.raw
agtatacatacacgaccggtgctcgatttagcgcagtacgaagggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttatactgtcagcaatattatactactccgtggactttcggccaagggaccaaggtggaaatcagacgaactgtggctgcaccatcttcg

SEQ ID NO: 539067 - DNA, 482 bp, Homo sapiens
  misc_feature: HIJSMM301CKAY9.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtacccgtggacgttcggccaacgggaccaacggtaggaagtacaaacgaactagtggcgtgca

SEQ ID NO: 539068 - DNA, 494 bp, Homo sapiens; identical to SEQ ID NO: 534992
  misc_feature: HIJSMM301E0WN9.9.1.A01.1.454.light.4.raw

SEQ ID NO: 539069 - DNA, 503 bp, Homo sapiens
  misc_feature: HIJSMM301CBPRA.48.26.C04.1.454.light.4.raw
agtatacatacacgaccggtgctcgatttagtctagcgactttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgcccccc

SEQ ID NO: 539070 - DNA, 494 bp, Homo sapiens
  misc_feature: HIJSMM301EB12A.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactggaccacggtcaccgtcctaggtcagcccaaggccaacccc

SEQ ID NO: 539071 - DNA, 475 bp, Homo sapiens
  misc_feature: HIJSMM301DRH50.48.45.E01.1.454.light.4.raw
agtatacatacacgaccggtgctcgatttagtgagtcagtaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcagggtccctgctcgcttctctggctccaagtctggcaacacggcctccctgaccatctctgggctccaggctgaagatgaggctgattatttctgctgctcatatgcagccaactattatgtcttcggaactgagaccaaggtcaccgtcct

SEQ ID NO: 539072 - DNA, 507 bp, Homo sapiens
  misc_feature: HIJSMM301A70DP.53.71.G05.1.454.light.4.raw
cgcgtatacacacgaccggtgctcgatttagtgtcgtcgcaagagagagggggtctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcggcggagggaccaagctgaccgtcctaggtcagcccaaggctcgccccctggtcactctcgtt

SEQ ID NO: 539073 - DNA, 521 bp, Homo sapiens; identical to SEQ ID NO: 538715
  misc_feature: HIJSMM301A0MYU.27.23.C01.1.454.light.4.raw

SEQ ID NO: 539074 - DNA, 494 bp, Homo sapiens
  misc_feature: HIJSMM301CI8TJ.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaacccactgtcact

SEQ ID NO: 539075 - DNA, 479 bp, Homo sapiens; identical to SEQ ID NO: 537163
  misc_feature: HIJSMM301C0C0Z.13.73.G07.1.454.light.4.raw

SEQ ID NO: 539076 - DNA, 476 bp, Homo sapiens
  misc_feature: HIJSMM301AGDRY.52.40.D07.1.454.light.4.raw
cgcagtacgacacgaccggtgctcgatttagtgatagagcgtaacaacagaggggagtcccagtcaggacacagcatggacatgagggtccccgctcagctcctggggctcctgctgctctggctcccaggtgccagatgtgacatccagttgacccagtctccatccttcctatctgcatctgtaggagacagagtcaccatcacttgtcgggcgagtcagggtattagcagctggttagcctggtatcagcagaaaccagggaaagcccctaagctcctgatctatgctgcatccactttgcagagtggggtcccatcaaggttcagcggcagtggatctgggagacaattcactctcacaatcagcagcctgcagcctgaagattttgcgacttattactgtcaacaacttaatcgttaccctcttttcggccctgggaccaaagtggatatcaaacgaactgtggctgcacc

SEQ ID NO: 539077 - DNA, 495 bp, Homo sapiens; identical to SEQ ID NO: 537716
  misc_feature: HIJSMM301C5A2V.22.14.B03.1.454.light.4.raw

SEQ ID NO: 539078 - DNA, 463 bp, Homo sapiens; identical to SEQ ID NO: 535062
  misc_feature: HIJSMM301CR6SE.11.73.G07.1.454.light.4.raw

SEQ ID NO: 539079 - DNA, 506 bp, Homo sapiens
  misc_feature: HIJSMM301A02EE.3.70.G04.1.454.light.4.raw
agacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccacttagcctggtaccagcagaaacctggccagcctcccagtctcctcatctatggagcacacaacagggccactggcatcccagccaggttcagtggcagtgggtctgggacagacttcaccctcatcatcagccgcctagagcctgaagattttgcagtttattactgtcagcagggttacttctggcccactttcggccctgggaccaaagtggatatcaaacgaactagtggctgcaccatctgtcttcatctttcccgccact

SEQ ID NO: 539080 - DNA, 486 bp, Homo sapiens; identical to SEQ ID NO: 535385
  misc_feature: HIJSMM301DAT4H.19.71.G05.1.454.light.4.raw

SEQ ID NO: 539081 - DNA, 482 bp, Homo sapiens
  misc_feature: HIJSMM301B4TLI.48.35.D02.1.454.light.4.raw
agtatacatacacgaccggtgctcgatttagcacacgatagttgggtttgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccatttttacaaagtggagtctcatcaaggttcagcggcggtggatctggcacagatttcactctcaccatcagcagcctgcagcctgaagattttgcaacttattactgtctgcacgattacaattacctcggacgttcggccaaggaccaaggtggaagtcaaacgaactgtggctgcacca

SEQ ID NO: 539082 - DNA, 507 bp, Homo sapiens
  misc_feature: HIJSMM301CRP7F.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccgtcctacgtcagccc

SEQ ID NO: 539083 - DNA, 504 bp, Homo sapiens
  misc_feature: HIJSMM301BH84G.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcatcttcccgcc

SEQ ID NO: 539084 - DNA, 474 bp, Homo sapiens
  misc_feature: HIJSMM301BMBCH.3.82.H05.1.454.light.4.raw
agacgcactccacgaccggtgctcgatttagtcgagctctctcgcggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagatttgcaacttactattgtcaacaggctgacagtctcccgctcactttcggcggagggaccaaggtggagatcaaacgaactgtggctgca

SEQ ID NO: 539085 - DNA, 479 bp, Homo sapiens; identical to SEQ ID NO: 535118
  misc_feature: HIJSMM301D6IED.13.59.F04.1.454.light.4.raw

SEQ ID NO: 539086 - DNA, 508 bp, Homo sapiens
  misc_feature: HIJSMM301AVFHC.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccggaacgacgtggaggatctaaccgaaccgtagtggcgtgtcaccaactctgtt

SEQ ID NO: 539087 - DNA, 478 bp, Homo sapiens
  misc_feature: HIJSMM301A7KP0.48.5.A05.1.454.light.4.raw
agtatacatacacgaccggtgctcgatttagatagatagacagggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccaaggtggaaatcaaacgaactagtggctgcaccat

SEQ ID NO: 539088 - DNA, 494 bp, Homo sapiens; identical to SEQ ID NO: 534992
  misc_feature: HIJSMM301BGBA2.9.1.A01.1.454.light.4.raw

SEQ ID NO: 539089 - DNA, 513 bp, Homo sapiens
  misc_feature: HIJSMM301BN3L2.17.62.F07.1.454.light.4.raw
cgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcctcctagtctacg

SEQ ID NO: 539090 - DNA, 486 bp, Homo sapiens
  misc_feature: HIJSMM301DXNV0.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgccctcctccgctacgtaga

SEQ ID NO: 539091 - DNA, 504 bp, Homo sapiens
  misc_feature: HIJSMM301DC7N9.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgc

SEQ ID NO: 539092 - DNA, 496 bp, Homo sapiens
  misc_feature: HIJSMM301ADSZ8.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaacgaactgtggctgcaccatctgtcttcatcttcccgccat

SEQ ID NO: 539093 - DNA, 516 bp, Homo sapiens
  misc_feature: HIJSMM301AENP0.12.88.H11.1.454.light.4.raw
  modified_base (498)..(498): a, c, t, g, unknown or other
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagattttcacactgaaaatcagccgggtggggcgtgaggagtgttggtcgatttatttaacttgcgatgtcgacggcgtattaacctaccttcccttcgccacttttcggtcgacgggacgaacgactggngagtacacggcggtaacg

SEQ ID NO: 539094 - DNA, 509 bp, Homo sapiens; identical to SEQ ID NO: 536047
  misc_feature: HIJSMM301AGKC0.17.33.C11.1.454.light.4.raw

SEQ ID NO: 539095 - DNA, 484 bp, Homo sapiens; identical to SEQ ID NO: 535400
  misc_feature: HIJSMM301D58WQ.46.26.C04.1.454.light.4.raw

SEQ ID NO: 539096 - DNA, 485 bp, Homo sapiens; identical to SEQ ID NO: 535501
  misc_feature: HIJSMM301EYYNW.3.10.A10.1.454.light.4.raw

SEQ ID NO: 539097 - DNA, 521 bp, Homo sapiens
  misc_feature: HIJSMM301CDR04.41.9.A09.1.454.light.4.raw
tctatactatcacgaccggtgctcgatttagcgagacgcgcaggggagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccggcagacggtgaccatctcctgttctggaagcagttccaacatcggaagtaataatgtgaattggtaccggcaactcccaggaacggcccccaaactcctcatacatagtaatgatcatcggccccctcggggtccctgaccgaatctctggctccaggtctggcgcctcagcctccctggtcattagtgggctccagtctgacgatgaggctgactattactgttctagcgtgggatgccagcccgaatcattgggtggttcggcgggagggaccgaaactgaccgtccctaggtcagcccaaggctcgccccctccggtcactctcg

SEQ ID NO: 539098 - DNA, 490 bp, Homo sapiens
  misc_feature: HIJSMM301CTS94.51.80.H03.1.454.light.4.raw
cgatcgtatacacgaccggtgctcgatttagctgtgcgtcgaagggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctattcggcggagggaccaagctgaccgtcctaggtcagcccaaggctgccccctcggtcact

SEQ ID NO: 539099 - DNA, 504 bp, Homo sapiens
  misc_feature: HIJSMM301DZZS4.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctcgccccctcggt

SEQ ID NO: 539100 - DNA, 482 bp, Homo sapiens
  misc_feature: HIJSMM301C82MV.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgca

SEQ ID NO: 539101 - DNA, 483 bp, Homo sapiens
  misc_feature: HIJSMM301ATS8X.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgcccctcggtca

SEQ ID NO: 539102 - DNA, 453 bp, Homo sapiens
  misc_feature: HIJSMM301C4F2G.18.78.H01.1.454.light.4.raw
tacgagtatgcacgaccggtgctcgatttagtgtgagtagtttgggtttgggggctttgcctgggcccagtctaccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccacctcctccatactcgta

SEQ ID NO: 539103 - DNA, 514 bp, Homo sapiens
  misc_feature: HIJSMM301C4FBN.14.19.B08.1.454.light.4.raw
cgtctagtaccacgaccggtgctcgatttagtgagtcagtaaggggagagaagacaggattcaggacaatctccagcatggtcggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccgcctcctcg

SEQ ID NO: 539104 - DNA, 487 bp, Homo sapiens
  misc_feature: HIJSMM301CW7VU.17.57.F02.1.454.light.4.raw
cgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagcaactttttaaattggtatcagcgggaaccagggaaagcccctaaactcctgatctatactgcatccaatttgcaaagtgggtcccatcaaggttcagtggcagtggatctgggacagatttcactctcaccatcagcagtctgcaacctgaggattttgcaacttactactgtcaacagggttacagtaccccgtacacttttggccaggggaccaagctggagatcaaacgaactgtggctgcaccat

SEQ ID NO: 539105 - DNA, 502 bp, Homo sapiens; identical to SEQ ID NO: 536604
  misc_feature: HIJSMM301A82G6.27.78.H01.1.454.light.4.raw

SEQ ID NO: 539106 - DNA, 515 bp, Homo sapiens
  misc_feature: HIJSMM301EN21K.3.88.H11.1.454.light.4.raw
  modified_base (419)..(419): a, c, t, g, unknown or other
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagtatttgactaacttactattgtacaacgnggactaactacgttttacctttaacttcgttccggaccggaacggacgaccgacgtaggagtaaacttaaacgaacttggtcggtctgaccaccta

SEQ ID NO: 539107 - DNA, 486 bp, Homo sapiens; identical to SEQ ID NO: 535290
  misc_feature: HIJSMM301AQN0B.3.12.B01.1.454.light.4.raw

SEQ ID NO: 539108 - DNA, 486 bp, Homo sapiens; identical to SEQ ID NO: 537428
  misc_feature: HIJSMM301CTJUM.47.62.F07.1.454.light.4.raw

SEQ ID NO: 539109 - DNA, 520 bp, Homo sapiens; identical to SEQ ID NO: 535686
  misc_feature: HIJSMM301AP4DR.41.19.B08.1.454.light.4.raw

SEQ ID NO: 539110 - DNA, 494 bp, Homo sapiens; identical to SEQ ID NO: 534992
  misc_feature: HIJSMM301D53N2.9.1.A01.1.454.light.4.raw

SEQ ID NO: 539111 - DNA, 486 bp, Homo sapiens; identical to SEQ ID NO: 535523
  misc_feature: HIJSMM301APPG0.22.73.G07.1.454.light.4.raw

SEQ ID NO: 539112 - DNA, 489 bp, Homo sapiens
  misc_feature: HIJSMM301AW82T.13.36.D03.1.454.light.4.raw
tcacgtactacacgaccggtgctcgatttagctgcgtcacgatctctcttgggggggtcgagagctctggggagggaactgctcagttaggacccacgacggaaccatggaagccccacgcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacgactggagattaaaggaa

SEQ ID NO: 539113 - DNA, 490 bp, Homo sapiens
  misc_feature: HIJSMM301D82O2.15.8.A08.1.454.light.4.raw
tctacgtagccacgaccggtgctcgatttagcatactctacagggggaggaactgctcagttaggacccagacggaaccatggaagccccagcgcagcttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgctagtttattactgtcagcaatataacaagtggccattcactttcggcccagggaccaaagtggatatcaaacgaactgtggctgcaccatctgtcttcat

SEQ ID NO: 539114 - DNA, 495 bp, Homo sapiens
  misc_feature: HIJSMM301D7GNK.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggccaggggaccccaggtggagatcagacgaactgtggctgcaccatctgtcttcatcttcccg

SEQ ID NO: 539115 - DNA, 493 bp, Homo sapiens; identical to SEQ ID NO: 537422
  misc_feature: HIJSMM301B6DPT.9.34.D01.1.454.light.4.raw

SEQ ID NO: 539116 - DNA, 491 bp, Homo sapiens
  misc_feature: HIJSMM301CIVPE.3.55.E11.1.454.light.4.raw
  modified_base (481)..(481): a, c, t, g, unknown or other
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccgaaggtaggaaatcaaacgaactagtggctgnaccatctgtt

SEQ ID NO: 539117 - DNA, 494 bp, Homo sapiens; identical to SEQ ID NO: 534994
  misc_feature: HIJSMM301BPJ1S.27.78.H01.1.454.light.4.raw

SEQ ID NO: 539118 - DNA, 487 bp, Homo sapiens; identical to SEQ ID NO: 537009
  misc_feature: HIJSMM301AGVFH.12.88.H11.1.454.light.4.raw

SEQ ID NO: 539119 - DNA, 501 bp, Homo sapiens
  misc_feature: HIJSMM301C7ULK.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgccctcctcgagtgcgtctctcgg

SEQ ID NO: 539120 - DNA, 483 bp, Homo sapiens
  misc_feature: HIJSMM301CF7HS.7.76.G10.1.454.light.4.raw
  modified_base (457)..(457): a, c, t, g, unknown or other
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaacggtaggngatcaaacgaactgtggctgcaccat

SEQ ID NO: 539121 - DNA, 477 bp, Homo sapiens
  misc_feature: HIJSMM301CHR3C.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaaggtggaaatcaaacgaactgtggctgca

SEQ ID NO: 539122 - DNA, 383 bp, Homo sapiens
  misc_feature: HIJSMM301E0L57.48.87.H10.1.454.light.4.raw
agtatacatacacgaccggtgctcgatttagcagtactgcgttgggtttgggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctctttttactgggcgtcttcccgggatccggggtccctgaccgattcagtgccagcgggtctgggacagacttcactctcacca

SEQ ID NO: 539123 - DNA, 447 bp, Homo sapiens; identical to SEQ ID NO: 535020
  misc_feature: HIJSMM301BUH4D.18.9.A09.1.454.light.4.raw

SEQ ID NO: 539124 - DNA, 521 bp, Homo sapiens
  misc_feature: HIJSMM301A2Q8X.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccaccctccca

SEQ ID NO: 539125 - DNA, 486 bp, Homo sapiens; identical to SEQ ID NO: 535043
  misc_feature: HIJSMM301AEYUN.46.35.D02.1.454.light.4.raw

SEQ ID NO: 539126 - DNA, 504 bp, Homo sapiens; identical to SEQ ID NO: 535561
  misc_feature: HIJSMM301AV6T1.4.57.F02.1.454.light.4.raw

SEQ ID NO: 539127 - DNA, 452 bp, Homo sapiens
  misc_feature: HIJSMM301EIA7Y.19.86.H09.1.454.light.4.raw
tactctcgtgcacgaccggtgctcgatttagtgctatagacttgggtttggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctcctccacgagagta

SEQ ID NO: 539128 - DNA, 490 bp, Homo sapiens
  misc_feature: HIJSMM301C9X1E.4.8.A08.1.454.light.4.raw
agcactgtagcacgaccggtgctcgatttagcatactctacaggggggccgtcaggaagcagcatcggagggtgcctcagccatggcatggatccctctcttcctcggcgtccttgcttactgcacaggatccgtgccctcctatgaactgactcagccaccgtcagtgtccgtgtccccaggacagacagccagcattagttgctctggagatagattggagaataaatttgttacctggtatcagcagaagccaggccagtcccctgtgctggtcatctatcaggataaggagcggccctcagggatccctgagcgaatctctggctccaactctgggaacacagccactctgaccatcagcgggacccaggctatggatgagggtgactattactgtcaggcgtgggacagcccttatgtggtattcggccggagggaccaagcgtgaccggtcctaggtcagcccaaggctgccccctcggtcact

SEQ ID NO: 539129 - DNA, 476 bp, Homo sapiens
  misc_feature: HIJSMM301CU5B1.52.73.G07.1.454.light.4.raw
cgcagtacgacacgaccggtgctcgatttagctctacgctcagggtgatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaaatcagcagagtggaggctgaggatgttggggtttattactgcatgcaagttctacaaaatcctcgcacttttggccaggggaccaagctggagatcaaacgaa

SEQ ID NO: 539130 - DNA, 494 bp, Homo sapiens
  misc_feature: HIJSMM301CHIO0.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaacggacggacggatcagacgaactgtggctgcaccatctgtcttcta

SEQ ID NO: 539131 - DNA, 456 bp, Homo sapiens
  misc_feature: HIJSMM301CMTER.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctccggtcactctgttcccgccctcctccaccgagagta

SEQ ID NO: 539132 - DNA, 496 bp, Homo sapiens; identical to SEQ ID NO: 535541
  misc_feature: HIJSMM301BK7M3.3.33.C11.1.454.light.4.raw

SEQ ID NO: 539133 - DNA, 484 bp, Homo sapiens; identical to SEQ ID NO: 538396
  misc_feature: HIJSMM301DTM2R.15.1.A01.1.454.light.4.raw

SEQ ID NO: 539134 - DNA, 444 bp, Homo sapiens; identical to SEQ ID NO: 535411
  misc_feature: HIJSMM301BKGI2.8.73.G07.1.454.light.4.raw

SEQ ID NO: 539135 - DNA, 485 bp, Homo sapiens
  misc_feature: HIJSMM301AKYGO.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccgtccgaggatgaggctgattattattgtgcaacatggggatagtagcctgagtagtgtggttttcggcggagggaccaaactgaccgtcctaggtcagcccaaggctgccccctcggtcactctgttcccaccctcctctacgtgagct

SEQ ID NO: 539136 - DNA, 481 bp, Homo sapiens
  misc_feature: HIJSMM301D6TVL.40.59.F04.1.454.light.4.raw
tctagcgactcacgaccggtgctcgatttagtacacacacttagggattgggggtggccgtcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctcgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaac

SEQ ID NO: 539137 - DNA, 455 bp, Homo sapiens
  misc_feature: HIJSMM301BNIQJ.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccgaccctcctccacgagagta

SEQ ID NO: 539138 - DNA, 509 bp, Homo sapiens
  misc_feature: HIJSMM301AOMM7.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtgtgctgtgctattcggcggagggaccaagctgaccgtcttaagtcagcccaaggctgccccctcggtcactctgttccca

SEQ ID NO: 539139 - DNA, 444 bp, Homo sapiens
  misc_feature: HIJSMM301AU5MI.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtcccgtgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccaccctctccgtgtctgat

SEQ ID NO: 539140 - DNA, 494 bp, Homo sapiens; identical to SEQ ID NO: 534992
  misc_feature: HIJSMM301A09BV.9.1.A01.1.454.light.4.raw

SEQ ID NO: 539141 - DNA, 479 bp, Homo sapiens
  misc_feature: HIJSMM301ESJ1G.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagcctccctggccatcactgggctccaggctgaggatgaggctgattattactgccagtcgtatgacagcagcctgagtgtttgggtgttcggcggagggacc

SEQ ID NO: 539142 - DNA, 463 bp, Homo sapiens; identical to SEQ ID NO: 535062
  misc_feature: HIJSMM301BUOUQ.11.73.G07.1.454.light.4.raw

SEQ ID NO: 539143 - DNA, 488 bp, Homo sapiens; identical to SEQ ID NO: 535125
  misc_feature: HIJSMM301DBPKY.17.25.C03.1.454.light.4.raw

SEQ ID NO: 539144 - DNA, 494 bp, Homo sapiens; identical to SEQ ID NO: 534994
  misc_feature: HIJSMM301AUORB.27.78.H01.1.454.light.4.raw

SEQ ID NO: 539145 - DNA, 515 bp, Homo sapiens
  misc_feature: HIJSMM301AWT4I.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctctacgttcggacggacggaacgaggacggagtactacgaacggaacgtaacgttggtcggctcgaccaacctattcgttcgttcctt

SEQ ID NO: 539146 - DNA, 478 bp, Homo sapiens
  misc_feature: HIJSMM301CMTP1.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatacaaacgaactgtggctgca

SEQ ID NO: 539147 - DNA, 500 bp, Homo sapiens
  misc_feature: HIJSMM301AYIPE.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgataccccgtggacgttcggccagggaccgaaggtaggagagtcaaacgaaactagtggctgcaccaatctgtcttcatcttcccgt

SEQ ID NO: 539148 - DNA, 447 bp, Homo sapiens; identical to SEQ ID NO: 535201
  misc_feature: HIJSMM301DMFMH.18.9.A09.1.454.light.4.raw

SEQ ID NO: 539149 - DNA, 507 bp, Homo sapiens
  misc_feature: HIJSMM301BYCM3.22.46.E02.1.454.light.4.raw
acatacgcgtcacgaccggtgctcgatttagactcatctacagggaaagggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaagccccccaactcttaatttttggtgtcaataaccgcccctcaggggtccctgatcgcttctccggctccaagtctggcaacacggcctccctgaccatctctggactccaggctgacgatgagggtgacttttactgctgctcatatgcaggcaactataatatggtcttcggcggagggaccaaagtgaccgtcctaggtcagcccaaggctgccccctcggtcact

SEQ ID NO: 539150 - DNA, 479 bp, Homo sapiens; identical to SEQ ID NO: 535118
  misc_feature: HIJSMM301CW3I2.13.59.F04.1.454.light.4.raw

SEQ ID NO: 539151 - DNA, 492 bp, Homo sapiens
  misc_feature: HIJSMM301AZYO1.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccgaaggcggagatcagacgaacctgtggctgcaccactctgtcttcta

SEQ ID NO: 539152 - DNA, 494 bp, Homo sapiens; identical to SEQ ID NO: 534994
  misc_feature: HIJSMM301CNA3H.27.78.H01.1.454.light.4.raw

SEQ ID NO: 539153 - DNA, 485 bp, Homo sapiens; identical to SEQ ID NO: 536040
  misc_feature: HIJSMM301BE9RH.15.1.A01.1.454.light.4.raw

SEQ ID NO: 539154 - DNA, 475 bp, Homo sapiens; identical to SEQ ID NO: 537714
  misc_feature: HIJSMM301A065Z.7.81.H04.1.454.light.4.raw

SEQ ID NO: 539155 - DNA, 464 bp, Homo sapiens
  misc_feature: HIJSMM301DK7U3.26.78.H01.1.454.light.4.raw
  modified_base (453)..(453): a, c, t, g, unknown or other
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtcttcatcttcccgccatctnaagtatagtct

SEQ ID NO: 539156 - DNA, 506 bp, Homo sapiens
  misc_feature: HIJSMM301AODB3.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggagtcaagcgaactgtggctgcaccatctgtcttcatcttcccgcc

SEQ ID NO: 539157 - DNA, 487 bp, Homo sapiens
  misc_feature: HIJSMM301DA9EJ.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactgtggctgcacc

SEQ ID NO: 539158 - DNA, 444 bp, Homo sapiens; identical to SEQ ID NO: 534993
  misc_feature: HIJSMM301A2NJF.5.9.A09.1.454.light.4.raw

SEQ ID NO: 539159 - DNA, 489 bp, Homo sapiens; identical to SEQ ID NO: 535139
  misc_feature: HIJSMM301AHFWZ.14.55.E11.1.454.light.4.raw

SEQ ID NO: 539160 - DNA, 510 bp, Homo sapiens
  misc_feature: HIJSMM301AKKKU.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgtccc

SEQ ID NO: 539161 - DNA, 505 bp, Homo sapiens; identical to SEQ ID NO: 535503
  misc_feature: HIJSMM301B7TUE.8.28.C06.1.454.light.4.raw

SEQ ID NO: 539162 - DNA, 466 bp, Homo sapiens; identical to SEQ ID NO: 535366
  misc_feature: HIJSMM301EIYRF.13.4.A04.1.454.light.4.raw

SEQ ID NO: 539163 - DNA, 475 bp, Homo sapiens
  misc_feature: HIJSMM301BX4BI.49.4.A04.1.454.light.4.raw
agtcgagagacacgaccggtgctcgatttagagtagtgatcagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcggggggaccgaaggtggaggatcaagcgaacgtgtgg

SEQ ID NO: 539164 - DNA, 495 bp, Homo sapiens
  misc_feature: HIJSMM301AZ7GD.7.59.F04.1.454.light.4.raw
cgtgtctctacacgaccggtgctcgatttagtacacacacttagggattggggagtcagacccagtcaggacacagcatggacatgagggtccccgctcagctcctggggctcctgctgctctggctcccaggtgccaaatgtgacatccagatgacccagtctccttcaccctgtctgcatctgtaggagacacagtcaccgtcacttgccgggccagtcagagtattagtaactcgttggcctggtatcagcagaaaccagggaaagcccctaagctcctgatctatatggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatcaaacgaactgtaggctgcaccatctgtcgttctac

SEQ ID NO: 539165 - DNA, 447 bp, Homo sapiens; identical to SEQ ID NO: 535020
  misc_feature: HIJSMM301ASJ38.18.9.A09.1.454.light.4.raw

SEQ ID NO: 539166 - DNA, 485 bp, Homo sapiens; identical to SEQ ID NO: 535822
  misc_feature: HIJSMM301CCA5L.14.53.E09.1.454.light.4.raw

SEQ ID NO: 539167 - DNA, 480 bp, Homo sapiens
  misc_feature: HIJSMM301CLV65.48.19.B08.1.454.light.4.raw
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattatactgctgctcatatgcaggcagctacacttgggtgttcggcggagggaccaagctgaccgtcctaggtcacg

SEQ ID NO: 539168 - DNA, 482 bp, Homo sapiens
  misc_feature: HIJSMM301EU8MV.5.28.C06.1.454.light.4.raw
atcagacacgcacgaccggtgctcgatttagagctcacgtattgggtttggggagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaaattcactttctaccatcagcagcctgcaacctgaagatattgcaacatattactgtcaacagtatgatagtctggccgccttcggcggagggaccgaaggtaggaggatcgaacgaaactgtggctgcaccat

SEQ ID NO: 539169 - DNA, 497 bp, Homo sapiens; identical to SEQ ID NO: 535740
  misc_feature: HIJSMM301CFUFI.3.71.G05.1.454.light.4.raw

SEQ ID NO: 539170 - DNA, 493 bp, Homo sapiens
  misc_feature: HIJSMM301AQC8W.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggacgaacgactggagatcaaccgaactagtggctgcaccact

SEQ ID NO: 539171 - DNA, 447 bp, Homo sapiens; identical to SEQ ID NO: 535020
  misc_feature: HIJSMM301EYFJ9.18.9.A09.1.454.light.4.raw

SEQ ID NO: 539172 - DNA, 499 bp, Homo sapiens
  misc_feature: HIJSMM301EGYTA.48.36.D03.1.454.light.4.raw
agtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaaccca

SEQ ID NO: 539173 - DNA, 446 bp, Homo sapiens; identical to SEQ ID NO: 538346
  misc_feature: HIJSMM301DTPLI.18.9.A09.1.454.light.4.raw

SEQ ID NO: 539174 - DNA, 506 bp, Homo sapiens; identical to SEQ ID NO: 534969
  misc_feature: HIJSMM301B0N30.18.37.D04.1.454.light.4.raw

SEQ ID NO: 539175 - DNA, 504 bp, Homo sapiens
  misc_feature: HIJSMM301A1NBR.48.53.E09.1.454.light.4.raw
agtatacatacacgaccggtgctcgatttagagagagtgtgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 539176 - DNA, 520 bp, Homo sapiens
  misc_feature: HIJSMM301DV8RX.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgcct

SEQ ID NO: 539177 - DNA, 501 bp, Homo sapiens
  misc_feature: HIJSMM301ASJDI.48.73.G07.1.454.light.4.raw
agtatacatacacgaccggtgctcgatttagctctacgctcgagggcacgaccggtgctcgatttagtgtcgtcgcaagagagaggggaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgttttctgtcagcagtatggaagttcacctcggacattcggccaggggaccaaggtggaaatcaaacgaactgtggctgcaccatctgtcttc

SEQ ID NO: 539178 - DNA, 493 bp, Homo sapiens; identical to SEQ ID NO: 536969
  misc_feature: HIJSMM301DJUH2.27.78.H01.1.454.light.4.raw

SEQ ID NO: 539179 - DNA, 494 bp, Homo sapiens; identical to SEQ ID NO: 534994
  misc_feature: HIJSMM301AL7CR.27.78.H01.1.454.light.4.raw

SEQ ID NO: 539180 - DNA, 440 bp, Homo sapiens
  misc_feature: HIJSMM301BLAW1.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccacctcctcgtatctctcg

SEQ ID NO: 539181 - DNA, 489 bp, Homo sapiens; identical to SEQ ID NO: 535139
  misc_feature: HIJSMM301ES6ZG.14.55.E11.1.454.light.4.raw

SEQ ID NO: 539182 - DNA, 510 bp, Homo sapiens
  misc_feature: HIJSMM301EE9QS.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcgtccaacggaccgaaggtaggaaagtacaaacgaacctagtggcgtgcaccaatctgtcttctatcttccccg

SEQ ID NO: 539183 - DNA, 514 bp, Homo sapiens
  misc_feature: HIJSMM301AQF94.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtcacggaccgaacggtggaagtactaagacgaacctagtggcgtgtcgaccactctcgtcttctactcttccccgt

SEQ ID NO: 539184 - DNA, 495 bp, Homo sapiens; identical to SEQ ID NO: 535821
  misc_feature: HIJSMM301AYUKH.3.31.C09.1.454.light.4.raw

SEQ ID NO: 539185 - DNA, 489 bp, Homo sapiens; identical to SEQ ID NO: 535091
  misc_feature: HIJSMM301DJLUX.47.36.D03.1.454.light.4.raw

SEQ ID NO: 539186 - DNA, 483 bp, Homo sapiens
  misc_feature: HIJSMM301CC68A.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccaagtttaaaagtgggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaactagtggctgcaccatctgtcttcta

SEQ ID NO: 539187 - DNA, 493 bp, Homo sapiens
  misc_feature: HIJSMM301AKC0G.14.30.C08.1.454.light.4.raw
cgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgacacccttttaaattggtatcagcagaagccagggaaagcccctaaacttctgatctatgatgcaaccaatttacaagatgggatcccatcaaggttcagtggcggtggatctggggcggatttcactctcaccatcagcagtctgcaacctgaagattttgcgacttactggtgtcaacagggttatcataacccgtacacttttggccaggggaccaagctggacatcatacgaactgtggctgcaccatctgtt

SEQ ID NO: 539188 - DNA, 486 bp, Homo sapiens; identical to SEQ ID NO: 535385
  misc_feature: HIJSMM301EKMIM.19.71.G05.1.454.light.4.raw

SEQ ID NO: 539189 - DNA, 493 bp, Homo sapiens
  misc_feature: HIJSMM301AYFUD.41.38.D05.1.454.light.4.raw
tctatactatcacgaccggtgctcgatttagtatctgatagttgggtttgggggaggccagacccacgtcaggacacagcatggacatgagggtccccgcctcagctcctggggcgtcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaccagggaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggaggaccagttgagaccaaacgaactgtggctgcaccatctgtcttcat

SEQ ID NO: 539190 - DNA, 479 bp, Homo sapiens
  misc_feature: HIJSMM301D6JUC.13.73.G07.1.454.light.4.raw
tcacgtactacacgaccggtgctcgatttagctctacgctcagggggatcagaactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaa

SEQ ID NO: 539191 - DNA, 444 bp, Homo sapiens; identical to SEQ ID NO: 535192
  misc_feature: HIJSMM301CQCFT.5.9.A09.1.454.light.4.raw

SEQ ID NO: 539192 - DNA, 487 bp, Homo sapiens
  misc_feature: HIJSMM301CACFH.19.71.G05.1.454.light.4.raw
tactctcgtgcacgaccggtgctcgatttagtgtcgtcgcaagagagaggggggaggtacaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcaggcgaa

SEQ ID NO: 539193 - DNA, 494 bp, Homo sapiens; identical to SEQ ID NO: 534992
  misc_feature: HIJSMM301EBEXI.9.1.A01.1.454.light.4.raw

SEQ ID NO: 539194 - DNA, 492 bp, Homo sapiens
  misc_feature: HIJSMM301CFD99.41.53.E09.1.454.light.4.raw
tctatactatcacgaccggtgctcgatttagagagagtgtgttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcgagggaccaagctgaccgtcaggtcagcccaagg

SEQ ID NO: 539195 - DNA, 512 bp, Homo sapiens
  misc_feature: HIJSMM301ARWX8.17.37.D04.1.454.light.4.raw
cgtagactagcacgaccggtgctcgatttagtagcatactgttgggtttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtccttggtcagcccaaggctgccccctcggtcactctgttccca

SEQ ID NO: 539196 - DNA, 490 bp, Homo sapiens
  misc_feature: HIJSMM301CYWE2.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgatcaccttcggccaagggacacgactggagattaaacgaactgtggctgcaccatctgtcttcat

SEQ ID NO: 539197 - DNA, 485 bp, Homo sapiens
  misc_feature: HIJSMM301A0BP7.17.26.C04.1.454.light.4.raw
cgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcaacagtctgcaacctgaagattttgcaacttactactgtcaacagagttacaatacccctcggctcactttcggcggagggaccaaggtggagatcaaacgaactgtggctgcaccat

SEQ ID NO: 539198 - DNA, 512 bp, Homo sapiens
  misc_feature: HIJSMM301AIUGM.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgcctcct

SEQ ID NO: 539199 - DNA, 490 bp, Homo sapiens
  misc_feature: HIJSMM301CP5RK.49.46.E02.1.454.light.4.raw
agtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtt

SEQ ID NO: 539200 - DNA, 534 bp, Homo sapiens
  misc_feature: HIJSMM301C49K3.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacggaggctgactattactcgcctactctactttggtggtgctgtgcttagttcggcgggacggacgaacgctcgaccgtacttaagtcacgacccaacggctccgcccccgtcggtccactctcgttcccccgtcccctccct

SEQ ID NO: 539201 - DNA, 354 bp, Homo sapiens; identical to SEQ ID NO: 535026
  misc_feature: HIJSMM301ECF6D.19.22.B11.1.454.light.4.raw

SEQ ID NO: 539202 - DNA, 493 bp, Homo sapiens
  misc_feature: HIJSMM301BLUTR.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcaatggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcat

SEQ ID NO: 539203 - DNA, 494 bp, Homo sapiens; identical to SEQ ID NO: 536221
  misc_feature: HIJSMM301A8ZKQ.15.59.F04.1.454.light.4.raw

SEQ ID NO: 539204 - DNA, 505 bp, Homo sapiens
  misc_feature: HIJSMM301CBYWG.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttccgcc

SEQ ID NO: 539205 - DNA, 532 bp, Homo sapiens
  misc_feature: HIJSMM301AKIXS.53.77.G11.1.454.light.4.raw
cgcgtatacacacgaccggtgctcgatttagctagtcactcaagggaaaggggagtctgggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaaagtgtgcactggtaccagcagatgccaggccaggcccctgtgttggtcgtctatgatgatagcgaccggccctcaggggtccctgagcgattctctggctccaactctgggaacacggccaccctgaccataagcagggtcgaagccggggatggggccgactattactgtcaggtgtgggatactagtagtgatcatccgttgggtgttcggcgggtgggaccaggctggaccgtcctaggtcacgccaaggctcgccccctcggtcactctcgttcccaccctcctctcg

SEQ ID NO: 539206 - DNA, 504 bp, Homo sapiens
  misc_feature: HIJSMM301BM0D6.4.71.G05.1.454.light.4.raw
  modified_base (499)..(499): a, c, t, g, unknown or other
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtcacnctgtt

SEQ ID NO: 539207 - DNA, 489 bp, Homo sapiens
  misc_feature: HIJSMM301AUY6I.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtctcctcgaggttcagtggcagtggatctgggacacatttcaccctcaccatcaatagcctggaagctgaagatgctgcaacttattactgtcatcagagtactactttacctcaagtgatcaccttcggccaagggacacga

SEQ ID NO: 539208 - DNA, 486 bp, Homo sapiens; identical to SEQ ID NO: 535043
  misc_feature: HIJSMM301BC7DX.46.35.D02.1.454.light.4.raw

SEQ ID NO: 539209 - DNA, 511 bp, Homo sapiens
  misc_feature: HIJSMM301DX8ZG.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgcctcctca

SEQ ID NO: 539210 - DNA, 494 bp, Homo sapiens; identical to SEQ ID NO: 535680
  misc_feature: HIJSMM301BJIM0.16.78.H01.1.454.light.4.raw

SEQ ID NO: 539211 - DNA, 515 bp, Homo sapiens
  misc_feature: HIJSMM301AGKIC.22.28.C06.1.454.light.4.raw
acatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccccg

SEQ ID NO: 539212 - DNA, 486 bp, Homo sapiens; identical to SEQ ID NO: 535043
  misc_feature: HIJSMM301AVMNE.46.35.D02.1.454.light.4.raw

SEQ ID NO: 539213 - DNA, 487 bp, Homo sapiens; identical to SEQ ID NO: 535704
  misc_feature: HIJSMM301BXH4F.52.83.H06.1.454.light.4.raw

SEQ ID NO: 539214 - DNA, 487 bp, Homo sapiens; identical to SEQ ID NO: 536025
  misc_feature: HIJSMM301C7JB9.17.34.D01.1.454.light.4.raw

SEQ ID NO: 539215 - DNA, 504 bp, Homo sapiens
  misc_feature: HIJSMM301D1WOE.48.15.B04.1.454.light.4.raw
agtatacatacacgaccggtgctcgatttagacagtatatatccgcggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttatactgtcaacaatattattctactccgccgacgttcggccggggaccaacgtggaaatcaacgaactgtggctgcaccatctgtcttcta

SEQ ID NO: 539216 - DNA, 519 bp, Homo sapiens
  misc_feature: HIJSMM301C1XNX.7.87.H10.1.454.light.4.raw
  modified_base (486)..(486): a, c, t, g, unknown or other
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccgggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgccacggacaacggtaggaaggtacgaacgaacagtggcgtgtcaccacnctcgtcttctactcttcccgtccactcctgact

SEQ ID NO: 539217 - DNA, 441 bp, Homo sapiens; identical to SEQ ID NO: 534971
  misc_feature: HIJSMM301CGRFY.11.3.A03.1.454.light.4.raw

SEQ ID NO: 539218 - DNA, 490 bp, Homo sapiens
  misc_feature: HIJSMM301EYCO7.15.74.G08.1.454.light.4.raw
tctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaagcccctaaactcctgatgtataaggcatctagcttagaaagtgggtgccatcaaggttcagcggcagtggatctgggacagaattcactctcaccatcagcaccctgcagcctgatgattttgcaacttattactgtcaacagtataatagtaattcctggacgttcggccaagggaccaaggtggaaagtacaaacgaactagtggctgcaccatctgtctt

SEQ ID NO: 539219 - DNA, 484 bp, Homo sapiens; identical to SEQ ID NO: 535400
  misc_feature: HIJSMM301CY1TB.46.26.C04.1.454.light.4.raw

SEQ ID NO: 539220 - DNA, 515 bp, Homo sapiens
  misc_feature: HIJSMM301A2M1G.13.36.D03.1.454.light.4.raw
tcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaagtgtgcactggtaccagcagaagccaggccaggcccctgtgctggtcgtctatgttgatagcgaccggccctcagggatccctgagcgattctcgggctccaactctgggaacacggccactctgaccatcagtagggtcgaagccggggatgaggccgactattactgtcaggtgtgggatagtagtcgtgagcatgtggtattcggcggagggaccaaactgaccgtcctaggtcagcccaaggctgccccctccggtcactctgttccccg

SEQ ID NO: 539221 - DNA, 484 bp, Homo sapiens; identical to SEQ ID NO: 536312
  misc_feature: HIJSMM301BI7SP.17.21.B10.1.454.light.4.raw

SEQ ID NO: 539222 - DNA, 486 bp, Homo sapiens; identical to SEQ ID NO: 535385
  misc_feature: HIJSMM301A6WQ4.19.71.G05.1.454.light.4.raw

SEQ ID NO: 539223 - DNA, 467 bp, Homo sapiens; identical to SEQ ID NO: 538403
  misc_feature: HIJSMM301EOLBB.41.48.E04.1.454.light.4.raw

SEQ ID NO: 539224 - DNA, 494 bp, Homo sapiens
  misc_feature: HIJSMM301CSZ5M.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcccgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctcgtacatgtacacttttggccaggggaccaacctggagatcagacgaact

SEQ ID NO: 539225 - DNA, 490 bp, Homo sapiens; identical to SEQ ID NO: 535936
  misc_feature: HIJSMM301AVQQM.16.68.G02.1.454.light.4.raw

SEQ ID NO: 539226 - DNA, 502 bp, Homo sapiens
  misc_feature: HIJSMM301BT4A2.51.29.C07.1.454.light.4.raw
cgatcgtatacacgaccggtgctcgatttagagtgctacgaagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggtccaagggaccgaaggtggaaagtagaaaggaacgtagtggcgtgcaccatctgtctt

SEQ ID NO: 539227 - DNA, 455 bp, Homo sapiens
  misc_feature: HIJSMM301AH2IW.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctccggtcactctgttcccaccctcctccacgagagta

SEQ ID NO: 539228 - DNA, 496 bp, Homo sapiens; identical to SEQ ID NO: 535541
  misc_feature: HIJSMM301CV8GY.3.33.C11.1.454.light.4.raw

SEQ ID NO: 539229 - DNA, 422 bp, Homo sapiens
  misc_feature: HIJSMM301C9496.41.15.B04.1.454.light.4.raw
tctatactatcacgaccggtgctcgatttagacagtatatatccgcgggcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 539230 - DNA, 503 bp, Homo sapiens; identical to SEQ ID NO: 536760
  misc_feature: HIJSMM301BPENE.47.55.E11.1.454.light.4.raw

SEQ ID NO: 539231 - DNA, 486 bp, Homo sapiens
  misc_feature: HIJSMM301CS2GZ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgccaaggaccgaagtaggagtatcagacgaa

SEQ ID NO: 539232 - DNA, 455 bp, Homo sapiens
  misc_feature: HIJSMM301AE9HB.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagtcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccgccctcctccacgagagta

SEQ ID NO: 539233 - DNA, 502 bp, Homo sapiens
  misc_feature: HIJSMM301EJ9XD.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaaactgtggctgcaccatctgtcttcatcttcccgccta

SEQ ID NO: 539234 - DNA, 496 bp, Homo sapiens; identical to SEQ ID NO: 535556
  misc_feature: HIJSMM301CUFJJ.26.80.H03.1.454.light.4.raw

SEQ ID NO: 539235 - DNA, 497 bp, Homo sapiens
  misc_feature: HIJSMM301D2MMF.26.80.H03.1.454.light.4.raw
  modified_base (464)..(464): a, c, t, g, unknown or other
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaacgaactntggctgcaccatctgtcttcatcttcccgccat

SEQ ID NO: 539236 - DNA, 480 bp, Homo sapiens
  misc_feature: HIJSMM301A0Q38.48.19.B08.1.454.light.4.raw
agtatacatacacgaccggtgctcgatttagtgagtcagtaaggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcacg

SEQ ID NO: 539237 - DNA, 501 bp, Homo sapiens
  misc_feature: HIJSMM301CDVO1.4.39.D06.1.454.light.4.raw
agcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctc

SEQ ID NO: 539238 - DNA, 496 bp, Homo sapiens; identical to SEQ ID NO: 536690
  misc_feature: HIJSMM301A8PXW.40.23.C01.1.454.light.4.raw

SEQ ID NO: 539239 - DNA, 477 bp, Homo sapiens; identical to SEQ ID NO: 535122
  misc_feature: HIJSMM301ELE8Q.26.72.G06.1.454.light.4.raw

SEQ ID NO: 539240 - DNA, 508 bp, Homo sapiens
  misc_feature: HIJSMM301AW6IA.40.16.B05.1.454.light.4.raw
tctagcgactcacgaccggtgctcgatttagagctcacgtaagggggtctcaggaggcagcactctcgggacgtctccaccatggcctgggccctgctcctcctcagcctcctcactcagggcacaggatcctggactcagtctgccctgactcagcctcgctcagtgtccgggtctcctggacagtcagtcaccctctcctgcactggaaccagcagtaatgttggtggttataactttgtctcctggtaccaacaccacccaggcaaagcccccaaattcttgatttatgatgtcaataagcggccctcaggggtccctgatcgcttctctggctccaagtctggcaacacggcctccctgaccatctctgggctccaggctgaggatgaggctgattattactgctgctcatttgcaggtagtttttgggtgttcggcggagggaccaagctgaccgtcctaggtcagcccaaggctgccccctcggtcactctgttcccaccct

SEQ ID NO: 539241 - DNA, 479 bp, Homo sapiens
  misc_feature: HIJSMM301EL76I.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacacctgcgtggttttggctgttcggcggcggacc

SEQ ID NO: 539242 - DNA, 513 bp, Homo sapiens; identical to SEQ ID NO: 535244
  misc_feature: HIJSMM301CA1LF.17.33.C11.1.454.light.4.raw

SEQ ID NO: 539243 - DNA, 472 bp, Homo sapiens
  misc_feature: HIJSMM301DYZO4.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcgggggaccgaaggtggacatcaaacgaa

SEQ ID NO: 539244 - DNA, 433 bp, Homo sapiens; identical to SEQ ID NO: 535337
  misc_feature: HIJSMM301CUHCP.18.5.A05.1.454.light.4.raw

SEQ ID NO: 539245 - DNA, 505 bp, Homo sapiens
  misc_feature: HIJSMM301DCTDX.11.21.B10.1.454.light.4.raw
cgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatacatccaacagggccactggcaccccagccaggttcagtggcagtgggtctgggacagacttcactctcaccatcagcagcctagagcctgaggattttgcagtttattactgtcagcagcgtatcgactggatcaccttcggtccaaggacgacgaactggaaattaaacgaaactagtggctgcaccaactctgtcttcatcttcccgt

SEQ ID NO: 539246 - DNA, 490 bp, Homo sapiens; identical to SEQ ID NO: 535234
  misc_feature: HIJSMM301CHIPY.17.21.B10.1.454.light.4.raw

SEQ ID NO: 539247 - DNA, 511 bp, Homo sapiens
  misc_feature: HIJSMM301DIGX7.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctgttcccaccctcctcgctacgtaga

SEQ ID NO: 539248 - DNA, 444 bp, Homo sapiens; identical to SEQ ID NO: 535027
  misc_feature: HIJSMM301ECWH6.8.73.G07.1.454.light.4.raw

SEQ ID NO: 539249 - DNA, 481 bp, Homo sapiens
  misc_feature: HIJSMM301DCUSL.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccaggggaccaggctggagatcagacgaactgt

SEQ ID NO: 539250 - DNA, 533 bp, Homo sapiens
  misc_feature: HIJSMM301BDBHL.52.29.C07.1.454.light.4.raw
cgcagtacgacacgaccggtgctcgatttagagtgctacgaagggaaaggggcgtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattatgtctcctggtaccaacaccacccaggcaaagcccccaaactcattatttatggtgtcggtgaccggccctcaggggtttcgaatcacttctctggctccaagtccggcaacacggcctccctgaccatctctgggctccaggccgaggacgaggctgattattactgcgcctcatatacaaacaacaacaattgggtgttcggcggagggaccaagctgaccgtcctaggtcagcccaaggctgccccctcggtcactctgttcccaccctcctctatacg

SEQ ID NO: 539251 - DNA, 514 bp, Homo sapiens
  misc_feature: HIJSMM301CLYT1.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtggacagtaatagtgatcccgagcaggttttcggcggtgggaccaagctgaccgtcctaagtcagcccaaggctcgccccctcggtcactctgttccccg

SEQ ID NO: 539252 - DNA, 441 bp, Homo sapiens; identical to SEQ ID NO: 534971
  misc_feature: HIJSMM301BAA1Z.11.3.A03.1.454.light.4.raw

SEQ ID NO: 539253 - DNA, 507 bp, Homo sapiens
  misc_feature: HIJSMM301DEOX0.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcattttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggaggaccaagctgaccgtcctaggtcagccaaggctcgccccctcggtcactctgtcccg

SEQ ID NO: 539254 - DNA, 503 bp, Homo sapiens
  misc_feature: HIJSMM301BL142.5.86.H09.1.454.light.4.raw
atcagacacgcacgaccggtgctcgatttagtgctatagacttgggtttgggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtca

SEQ ID NO: 539255 - DNA, 502 bp, Homo sapiens; identical to SEQ ID NO: 537363
  misc_feature: HIJSMM301D3T0A.18.23.C01.1.454.light.4.raw

SEQ ID NO: 539256 - DNA, 511 bp, Homo sapiens
  misc_feature: HIJSMM301ATR3R.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgatccagtggcagcgggtctgggacagatttcactctcaccatcagcagcctgcaggctgaagatgtggcagtttattactgtcaacagttttctcgggcgttcggtccaagggaccgaaggtggaaagtacaaacgaaactacgtggctgcaccactctgtcttcatctttccccg

SEQ ID NO: 539257 - DNA, 505 bp, Homo sapiens
  misc_feature: HIJSMM301DJEPD.2.21.B10.1.454.light.4.raw
acgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtccacgtcagcccaaggctgccccctggtcactctcg

SEQ ID NO: 539258 - DNA, 513 bp, Homo sapiens
  misc_feature: HIJSMM301BEL57.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccaccctcctcta

SEQ ID NO: 539259 - DNA, 484 bp, Homo sapiens; identical to SEQ ID NO: 537891
  misc_feature: HIJSMM301CT8UB.10.1.A01.1.454.light.4.raw

SEQ ID NO: 539260 - DNA, 486 bp, Homo sapiens; identical to SEQ ID NO: 535043
  misc_feature: HIJSMM301EC9NV.46.35.D02.1.454.light.4.raw

SEQ ID NO: 539261 - DNA, 491 bp, Homo sapiens; identical to SEQ ID NO: 538238
  misc_feature: HIJSMM301BH4AK.26.78.H01.1.454.light.4.raw

SEQ ID NO: 539262 - DNA, 491 bp, Homo sapiens; identical to SEQ ID NO: 535194
  misc_feature: HIJSMM301APUCA.26.78.H01.1.454.light.4.raw

SEQ ID NO: 539263 - DNA, 484 bp, Homo sapiens
  misc_feature: HIJSMM301BBJE5.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaatagggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtcttcta

SEQ ID NO: 539264 - DNA, 482 bp, Homo sapiens; identical to SEQ ID NO: 535216
  misc_feature: HIJSMM301DYYIN.17.26.C04.1.454.light.4.raw

SEQ ID NO: 539265 - DNA, 486 bp, Homo sapiens; identical to SEQ ID NO: 535043
  misc_feature: HIJSMM301A8T3A.46.35.D02.1.454.light.4.raw

SEQ ID NO: 539266 - DNA, 490 bp, Homo sapiens
  misc_feature: HIJSMM301A3JW7.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggtccgagggaccgaagctggagatcacaggaactgtggctgcaccat

SEQ ID NO: 539267 - DNA, 495 bp, Homo sapiens
  misc_feature: HIJSMM301BDR6N.21.27.C05.1.454.light.4.raw
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccaaggtggaaatcaaacgaactgtggctgcaccatctgtctt

SEQ ID NO: 539268 - DNA, 501 bp, Homo sapiens
  misc_feature: HIJSMM301DQIUT.40.33.C11.1.454.light.4.raw
tctagcgactcacgaccggtgctcgattagagtgagctcgttgggtttggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtcctaggtcagcccaaggctgccccctc

SEQ ID NO: 539269 - DNA, 509 bp, Homo sapiens
  misc_feature: HIJSMM301EZT92.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctgttccca

SEQ ID NO: 539270 - DNA, 486 bp, Homo sapiens; identical to SEQ ID NO: 535043
  misc_feature: HIJSMM301BA9HG.46.35.D02.1.454.light.4.raw

SEQ ID NO: 539271 - DNA, 486 bp, Homo sapiens; identical to SEQ ID NO: 535917
  misc_feature: HIJSMM301CFUO9.3.10.A10.1.454.light.4.raw

SEQ ID NO: 539272 - DNA, 495 bp, Homo sapiens; identical to SEQ ID NO: 535143
  misc_feature: HIJSMM301COWR6.51.29.C07.1.454.light.4.raw

SEQ ID NO: 539273 - DNA, 486 bp, Homo sapiens; identical to SEQ ID NO: 536323
  misc_feature: HIJSMM301C6L9F.10.2.A02.1.454.light.4.raw

SEQ ID NO: 539274 - DNA, 484 bp, Homo sapiens
  misc_feature: HIJSMM301B6I6F.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagatttgcaacttactattgtcaacaggctaacagtttccctttaatcttcggccaagggacacgactggagattaaacgaactgtggctgcacca

SEQ ID NO: 539275 - DNA, 492 bp, Homo sapiens; identical to SEQ ID NO: 537509
  misc_feature: HIJSMM301AJJ2O.13.46.E02.1.454.light.4.raw

SEQ ID NO: 539276 - DNA, 489 bp, Homo sapiens; identical to SEQ ID NO: 535139
  misc_feature: HIJSMM301DY18T.14.55.E11.1.454.light.4.raw

SEQ ID NO: 539277 - DNA, 477 bp, Homo sapiens
  misc_feature: HIJSMM301CAPFJ.4.10.A10.1.454.light.4.raw
agcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtggggtcccatcaaggttcagcggcagtggatctgggacagatttcactctcaccatcagcagcctacagcctgaagattttgcaacttattactgtcaacagcttaataattacgcgctcactttcggcggagggaccaaggtggagatcaaacgaactgtggctgcaccat

SEQ ID NO: 539278 - DNA, 480 bp, Homo sapiens
  misc_feature: HIJSMM301CMPRX.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaaggctgaccgtcctaagtcagcccaac

SEQ ID NO: 539279 - DNA, 521 bp, Homo sapiens
  misc_feature: HIJSMM301A6XSQ.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccgaccctcagggatccctgagcgattctctggctccaagtctgggaacacggccaccctgaccatcagcagggtcgaagccggggatgaggccgactattactgtcaggtgtggaatggtgatatgattatgtcttcggaactgggaccaaggtcaccgtcctaggtcagcccaaggaccaaccccacctgtcactctcgttccctacccctcctccgt

SEQ ID NO: 539280 - DNA, 508 bp, Homo sapiens
  misc_feature: HIJSMM301D4LG1.51.86.H09.1.454.light.4.raw
cgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatcaaacgaactgtggctgcaccatctgtcttcat

SEQ ID NO: 539281 - DNA, 460 bp, Homo sapiens; identical to SEQ ID NO: 536053
  misc_feature: HIJSMM301DJCO0.22.28.C06.1.454.light.4.raw

SEQ ID NO: 539282 - DNA, 502 bp, Homo sapiens
  misc_feature: HIJSMM301D2DPX.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttatctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaaatgggaccaaggtcaccgtcctaggtcagcccaaggccaacccactgtca

SEQ ID NO: 539283 - DNA, 507 bp, Homo sapiens
  misc_feature: HIJSMM301DS7KW.5.59.F04.1.454.light.4.raw
atcagacacgcacgaccggtgctcgatttagtacacacacttagggattggggagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccgaaggaccgaaggtggaaagtacaaacgaactagtggctgcaccatctgtcttctatcttccccg

SEQ ID NO: 539284 - DNA, 481 bp, Homo sapiens
  misc_feature: HIJSMM301A0HSM.52.73.G07.1.454.light.4.raw
cgcagtacgacacgaccggtgctcgatttagctctacgctcagggcacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaa

SEQ ID NO: 539285 - DNA, 508 bp, Homo sapiens
  misc_feature: HIJSMM301B1BL5.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactctgttcccta

SEQ ID NO: 539286 - DNA, 493 bp, Homo sapiens
  misc_feature: HIJSMM301DBI38.49.27.C05.1.454.light.4.raw
agtcgagagacacgaccggtgctcgatttagacgcgatcgaagggtttggggagaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgt

SEQ ID NO: 539287 - DNA, 508 bp, Homo sapiens; identical to SEQ ID NO: 536062
  misc_feature: HIJSMM301EPQNB.11.57.F02.1.454.light.4.raw

SEQ ID NO: 539288 - DNA, 495 bp, Homo sapiens
  misc_feature: HIJSMM301DFOVF.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctggggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 539289 - DNA, 496 bp, Homo sapiens; identical to SEQ ID NO: 535109
  misc_feature: HIJSMM301AWGOS.16.78.H01.1.454.light.4.raw

SEQ ID NO: 539290 - DNA, 488 bp, Homo sapiens
  misc_feature: HIJSMM301BJ1B1.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttcccctcactttcggcggagggaccaaggtggagatcaagcgaactgtggctgcaccatctgtctt

SEQ ID NO: 539291 - DNA, 491 bp, Homo sapiens
  misc_feature: HIJSMM301C8M3H.21.9.A09.1.454.light.4.raw
tcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggggggcagagtctccatcacttgccgggccagtcagaatatttatagctggttggcctggtatcagcagaaaccaggaaaagcccctaacctcctgatatatcgggcgtctaatttagaaagtggggtcccatcgaggttcagcggcagtggctctgggacagaattcactctcaccatcagcggcctgcagcccgatgattttgcaacttattactgccaacattacaatgattactcgcgtacgttcggccaagggaccagggtggaaatcaaacgaactgtggctgcaccatctgtcttcat

SEQ ID NO: 539292 - DNA, 505 bp, Homo sapiens
  misc_feature: HIJSMM301A21GO.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtcta

SEQ ID NO: 539293 - DNA, 490 bp, Homo sapiens; identical to SEQ ID NO: 535526
  misc_feature: HIJSMM301DBSPM.26.78.H01.1.454.light.4.raw

SEQ ID NO: 539294 - DNA, 486 bp, Homo sapiens
  misc_feature: HIJSMM301BZYI7.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgcaacttattattgtcaacaaagttatgagacccctgccactttcggccctgggaccatagtggatatgaaacgaactgtggctgcacc

SEQ ID NO: 539295 - DNA, 485 bp, Homo sapiens
  misc_feature: HIJSMM301AG21A.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagaacttttggtcaggggaccaagctggagatcaaacgaactgtggctgcaccat

SEQ ID NO: 539296 - DNA, 466 bp, Homo sapiens
  misc_feature: HIJSMM301BMJWV.13.4.A04.1.454.light.4.raw
  modified_base (416)..(416): a, c, t, g, unknown or other
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgntaatctcccgatcaccttcggccaagggacacgactggagattaaacgaa

SEQ ID NO: 539297 - DNA, 497 bp, Homo sapiens; identical to SEQ ID NO: 539058
  misc_feature: HIJSMM301C56ZI.12.87.H10.1.454.light.4.raw

SEQ ID NO: 539298 - DNA, 384 bp, Homo sapiens
  misc_feature: HIJSMM301DA8KR.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaaactgtggctgcaccatctgtcttcatcttcccgccatctgaatagtataga

SEQ ID NO: 539299 - DNA, 485 bp, Homo sapiens
  misc_feature: HIJSMM301DUJ3W.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtctaggtcagcccaaggccaaccca

SEQ ID NO: 539300 - DNA, 444 bp, Homo sapiens; identical to SEQ ID NO: 534993
  misc_feature: HIJSMM301ASG0K.5.9.A09.1.454.light.4.raw

SEQ ID NO: 539301 - DNA, 373 bp, Homo sapiens
  misc_feature: HIJSMM301A4MXV.21.25.C03.1.454.light.4.raw
tcgtcgctcgcacgaccggtgctcgatttagtagtgtagatttgggtttgggagcagctccaacatcgggtcaccttttgatgtgcactggtatcagcaacttccaggaacagcccccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggtttttggctgttcggcggcgggaccaagctgaccgtcctaggtcagcccaaggctgccccctcggtcactctgttcccaccctcctccgagcgacga

SEQ ID NO: 539302 - DNA, 477 bp, Homo sapiens
  misc_feature: HIJSMM301BI1VZ.52.34.D01.1.454.light.4.raw
cgcagtacgacacgaccggtgctcgatttagatcgtctgtgttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtcccctgtcctggtcatctatcaagatgtcaagcggccctcagggatccctgagcgattctctggctccaactctgggaacacagccactctgaccatcagcgggacccaggctatggatgaggctgactattactgtcaggcgtgggacagcaacactgtggtattcggcggagggaccaagctgaccgtcctaggtcagcccaac

SEQ ID NO: 539303 - DNA, 506 bp, Homo sapiens
  misc_feature: HIJSMM301EM0MI.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcatcttcccgccat

SEQ ID NO: 539304 - DNA, 447 bp, Homo sapiens
  misc_feature: HIJSMM301A9TTF.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggcaacccctctgtcactctgttcccaccctcctccatactcgta

SEQ ID NO: 539305 - DNA, 483 bp, Homo sapiens; identical to SEQ ID NO: 536691
  misc_feature: HIJSMM301EYLDH.17.26.C04.1.454.light.4.raw

SEQ ID NO: 539306 - DNA, 507 bp, Homo sapiens; identical to SEQ ID NO: 535455
  misc_feature: HIJSMM301AQJC3.8.28.C06.1.454.light.4.raw

SEQ ID NO: 539307 - DNA, 511 bp, Homo sapiens
  misc_feature: HIJSMM301AZZWZ.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaatagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccaacggtggagatcaaacgaactagtggcgtgcaccatctgtcttcta

SEQ ID NO: 539308 - DNA, 496 bp, Homo sapiens; identical to SEQ ID NO: 535541
  misc_feature: HIJSMM301A24IU.3.33.C11.1.454.light.4.raw

SEQ ID NO: 539309 - DNA, 477 bp, Homo sapiens
  misc_feature: HIJSMM301BG9FW.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtgcccgctcattttcggcggagggccaaggtgcagatcaaacgaactgtgg

SEQ ID NO: 539310 - DNA, 504 bp, Homo sapiens
  misc_feature: HIJSMM301B25FE.43.38.D05.1.454.light.4.raw
tgtgagtagtcacgaccggtgctcgatttagtatctgatagttgggtttggggagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaagggaccgagggtggaaagtacaaacgaactagtggctgcaccatctgtcttcatcttcccgtcca

SEQ ID NO: 539311 - DNA, 490 bp, Homo sapiens
  misc_feature: HIJSMM301ARTFN.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaaggacgacgactggagattaaacgaactagtggctgcaccatctgtcttcat

SEQ ID NO: 539312 - DNA, 491 bp, Homo sapiens; identical to SEQ ID NO: 536211
  misc_feature: HIJSMM301CC3PE.16.53.E09.1.454.light.4.raw

SEQ ID NO: 539313 - DNA, 492 bp, Homo sapiens; identical to SEQ ID NO: 536010
  misc_feature: HIJSMM301B8MMQ.10.20.B09.1.454.light.4.raw

SEQ ID NO: 539314 - DNA, 502 bp, Homo sapiens
  misc_feature: HIJSMM301CNAMZ.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaaccccactgtca

SEQ ID NO: 539315 - DNA, 485 bp, Homo sapiens
  misc_feature: HIJSMM301AQM1J.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttccctttaatcttcggccaagggacacgactggagattaaacgaactgtggctgcacca

SEQ ID NO: 539316 - DNA, 499 bp, Homo sapiens; identical to SEQ ID NO: 538643
  misc_feature: HIJSMM301CD8ET.48.1.A01.1.454.light.4.raw

SEQ ID NO: 539317 - DNA, 498 bp, Homo sapiens; identical to SEQ ID NO: 535295
  misc_feature: HIJSMM301DCHBJ.15.25.C03.1.454.light.4.raw

SEQ ID NO: 539318 - DNA, 506 bp, Homo sapiens
  misc_feature: HIJSMM301DGFZ1.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaactgtggctgcaccatctgtcttc

SEQ ID NO: 539319 - DNA, 454 bp, Homo sapiens; identical to SEQ ID NO: 536347
  misc_feature: HIJSMM301AH4FU.19.86.H09.1.454.light.4.raw

SEQ ID NO: 539320 - DNA, 509 bp, Homo sapiens; identical to SEQ ID NO: 539269
  misc_feature: HIJSMM301EOJ9D.4.57.F02.1.454.light.4.raw

SEQ ID NO: 539321 - DNA, 494 bp, Homo sapiens; identical to SEQ ID NO: 534994
  misc_feature: HIJSMM301BTCPC.27.78.H01.1.454.light.4.raw

SEQ ID NO: 539322 - DNA, 506 bp, Homo sapiens
  misc_feature: HIJSMM301BMOAY.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgtttcactttcggcggagggaccaaggtggacctcaaacgaactgtggctgcaccatctgtcttcatcttcccgcc

SEQ ID NO: 539323 - DNA, 489 bp, Homo sapiens
  misc_feature: HIJSMM301CROWQ.49.46.E02.1.454.light.4.raw
agtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgt

SEQ ID NO: 539324 - DNA, 507 bp, Homo sapiens
  misc_feature: HIJSMM301BAHX8.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccgaagggaccaaggtaggaaagtacaaacgaactagtggctgcaccatctgtcttctatcttccccg

SEQ ID NO: 539325 - DNA, 498 bp, Homo sapiens
  misc_feature: HIJSMM301DSFHK.40.43.D10.1.454.light.4.raw
tctagcgactcacgaccggtgctcgatttagactagcagtaagggggaggaactgctcagttaggacccagagggaaccatggaagccccacgctcagcttctcttcctcctgctactctggctcccagaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgcactttattactgtcaccagcgtagcagctggcctcgaacgttcggccaagggaccaaggtggacatcaagcgaactgtggctgcaccatctgtcttcatcttcccgcc

SEQ ID NO: 539326 - DNA, 495 bp, Homo sapiens
  misc_feature: HIJSMM301ASM3G.52.86.H09.1.454.light.4.raw
cgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 539327 - DNA, 382 bp, Homo sapiens; identical to SEQ ID NO: 534990
  misc_feature: HIJSMM301BYGPS.41.26.C04.1.454.light.4.raw

SEQ ID NO: 539328 - DNA, 488 bp, Homo sapiens
  misc_feature: HIJSMM301EGONA.49.67.G01.1.454.light.4.raw
agtcgagagacacgaccggtgctcgatttagagtatacatattgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatct

SEQ ID NO: 539329 - DNA, 492 bp, Homo sapiens; identical to SEQ ID NO: 535335
  misc_feature: HIJSMM301ASLJL.16.53.E09.1.454.light.4.raw

SEQ ID NO: 539330 - DNA, 444 bp, Homo sapiens; identical to SEQ ID NO: 535594
  misc_feature: HIJSMM301A6MOL.9.9.A09.1.454.light.4.raw

SEQ ID NO: 539331 - DNA, 485 bp, Homo sapiens; identical to SEQ ID NO: 535606
  misc_feature: HIJSMM301BOL4R.47.46.E02.1.454.light.4.raw

SEQ ID NO: 539332 - DNA, 490 bp, Homo sapiens
  misc_feature: HIJSMM301E1B0U.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattcttccagcgtttcggccaggggaccaaggtggaagtcaagcgaactgtggctgcaccatctgt

SEQ ID NO: 539333 - DNA, 496 bp, Homo sapiens
  misc_feature: HIJSMM301AYX73.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgtcgcaggacgaaggaggaagtacaaacaactagtggcgtgcaccatctgtcttcta

SEQ ID NO: 539334 - DNA, 444 bp, Homo sapiens; identical to SEQ ID NO: 535192
  misc_feature: HIJSMM301AR3D8.5.9.A09.1.454.light.4.raw

SEQ ID NO: 539335 - DNA, 505 bp, Homo sapiens; identical to SEQ ID NO: 535503
  misc_feature: HIJSMM301BUXEU.8.28.C06.1.454.light.4.raw

SEQ ID NO: 539336 - DNA, 501 bp, Homo sapiens
  misc_feature: HIJSMM301CXT86.7.71.G05.1.454.light.4.raw
cgtgtctctacacgaccggtgctcgatttagtgtcgtcgcaagagagagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctgagcctgaagatgttgcagtttattactgtcaacatcgtaccgagtggcctccgggggccacttcggccctggaccgaagtggatatcaaacgaactgtggctgcaccatctgtctt

SEQ ID NO: 539337 - DNA, 490 bp, Homo sapiens; identical to SEQ ID NO: 535234
  misc_feature: HIJSMM301AMW0H.17.21.B10.1.454.light.4.raw

SEQ ID NO: 539338 - DNA, 489 bp, Homo sapiens
  misc_feature: HIJSMM301BMPH7.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaaggtaggagatcaaacgaa

SEQ ID NO: 539339 - DNA, 481 bp, Homo sapiens; identical to SEQ ID NO: 535993
  misc_feature: HIJSMM301D7UTO.21.25.C03.1.454.light.4.raw

SEQ ID NO: 539340 - DNA, 490 bp, Homo sapiens
  misc_feature: HIJSMM301AMPVD.4.24.C02.1.454.light.4.raw
agcactgtagcacgaccggtgctcgatttagtacagatcgttagggaaagggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataacagttattggacgttcggccaagggaccaaggtggaaatcagacgaactgtgctgcaccatctgtcttcta

SEQ ID NO: 539341 - DNA, 502 bp, Homo sapiens
  misc_feature: HIJSMM301ARAHB.40.41.D08.1.454.light.4.raw
tctagcgactcacgaccggtgctcgatttagtcacgcgagaaagggaaagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcggggtgttcggcggagggaccaagctgaccgtcctaggtcagcccg

SEQ ID NO: 539342 - DNA, 508 bp, Homo sapiens
  misc_feature: HIJSMM301EL08Q.40.23.C01.1.454.light.4.raw
tctagcgactcacgaccggtgctcgatttagtacacgtgattagggattggggggggagggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggaccgacttcactctaaccatcagtagactggaacctgaagactctgcagtgtattactgtcaacactttgaaggcccacttatcacattcggcggagggaccaaggtggagatcaagcgaactgtggctgcaccatctgtcttcatcttccccg

SEQ ID NO: 539343 - DNA, 416 bp, Homo sapiens
  misc_feature: HIJSMM301ASHQ5.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccaccctcctccatactcgta

SEQ ID NO: 539344 - DNA, 486 bp, Homo sapiens
  misc_feature: HIJSMM301A9MLU.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccaatcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaacgaactgtggctgcaccat

SEQ ID NO: 539345 - DNA, 486 bp, Homo sapiens
  misc_feature: HIJSMM301C44FU.13.5.A05.1.454.light.4.raw
tcacgtactacacgaccggtgctcgatttagatagatagacaggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagaaatggatatacctatttggattggtatctgcagaagccagggcagtctccacaactcctgatctattggggttctaatcgggcctccggggtccctgacaggttcagtggcagtggatcaggcacagattttacactgaaaatcagcagagtggaggctgaggatgttggggtttattactgcatgcaagctctacaaactctgcggactttggccctgggaccaaagtggaggatcaaacgaactagtgg

SEQ ID NO: 539346 - DNA, 495 bp, Homo sapiens
  misc_feature: HIJSMM301ATUW1.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggtccaggggaccgaaggtggaaggtcaagcgaactagtggctgcgaccactctgtt

SEQ ID NO: 539347 - DNA, 484 bp, Homo sapiens
  misc_feature: HIJSMM301A5AQM.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttcctttaatcttcggccaagggacacgactggagattaaacgaactgtggctgcacca

SEQ ID NO: 539348 - DNA, 493 bp, Homo sapiens; identical to SEQ ID NO: 535745
  misc_feature: HIJSMM301EEUSL.47.78.H01.1.454.light.4.raw

SEQ ID NO: 539349 - DNA, 444 bp, Homo sapiens; identical to SEQ ID NO: 535192
  misc_feature: HIJSMM301EGV50.5.9.A09.1.454.light.4.raw

SEQ ID NO: 539350 - DNA, 496 bp, Homo sapiens; identical to SEQ ID NO: 535109
  misc_feature: HIJSMM301BMF9B.16.78.H01.1.454.light.4.raw

SEQ ID NO: 539351 - DNA, 513 bp, Homo sapiens; identical to SEQ ID NO: 535244
  misc_feature: HIJSMM301A78XJ.17.33.C11.1.454.light.4.raw

SEQ ID NO: 539352 - DNA, 509 bp, Homo sapiens
  misc_feature: HIJSMM301BIZ97.18.37.D04.1.454.light.4.raw
tacgagtatgcacgaccggtgctcgatttagtagcatactgttggggtttgggggactgatcaggactcctcagttcaccttctcacaatgaggcctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagagtcaaacgaactgtaggctgcacatctgtt

SEQ ID NO: 539353 - DNA, 423 bp, Homo sapiens
  misc_feature: HIJSMM301A2JHW.41.13.B02.1.454.light.4.raw
tctatactatcacgaccggtgctcgatttagtctagcgacttccgcgggcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaaactgtggctgcaccatctgtcttcatcttcccgccatctgaatagtataga

SEQ ID NO: 539354 - DNA, 433 bp, Homo sapiens
  misc_feature: HIJSMM301CU0QE.10.38.D05.1.454.light.4.raw
catagtagtgcacgaccggtgctcgatttagtatctgatagttgggtttgggggtgtggtggtctccactccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccaccctcctccactactatg

SEQ ID NO: 539355 - DNA, 491 bp, Homo sapiens
  misc_feature: HIJSMM301AHSXL.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtaggacgatcaagcgaactagtggctgcaccatct

SEQ ID NO: 539356 - DNA, 487 bp, Homo sapiens
  misc_feature: HIJSMM301EBHF0.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcggggacgaagtggagatcaacgaactgtggctgcaccatct

SEQ ID NO: 539357 - DNA, 514 bp, Homo sapiens
  misc_feature: HIJSMM301A7E6X.15.86.H09.1.454.light.4.raw
tctacgtagccacgaccggtgctcgatttagtgctatagacttgggtttgggggacttccctggtctccttctacctactgcccttcatttctccacaggtctctgtgctctgcctgtgctgactcagcccccgtcctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccgccctcctcgctacgtagac

SEQ ID NO: 539358 - DNA, 465 bp, Homo sapiens
  misc_feature: HIJSMM301ESU9E.26.78.H01.1.454.light.4.raw
agactatactcacgaccggtgctcgatttagtgtgagtagtttgggtttgggggaggaactgctcagttaggacccagagggaaccatggaagccccacgctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtcttcatcttcccgccatctgaagtatagtct

SEQ ID NO: 539359 - DNA, 509 bp, Homo sapiens
  misc_feature: HIJSMM301BNO3M.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgtt

SEQ ID NO: 539360 - DNA, 488 bp, Homo sapiens; identical to SEQ ID NO: 535990
  misc_feature: HIJSMM301CBIBG.11.28.C06.1.454.light.4.raw

SEQ ID NO: 539361 - DNA, 492 bp, Homo sapiens
  misc_feature: HIJSMM301C6CJG.53.5.A05.1.454.light.4.raw
cgcgtatacacacgaccggtgctcgatttagatagatagacagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggccctctattggtaatgtataaagacaatgagaggccctcagggatccctgagcgattctctggctccaactcagggacaacagtcacgttgaccatcggtggagtccaggcagaagacgaggctgactattactgtcaatcagcaggcagcagtggaactgtgctttcggcggagggaccaagctgaccgtcctacgtcagcccaaggctgccccctggtccactctgtt

SEQ ID NO: 539362 - DNA, 500 bp, Homo sapiens
  misc_feature: HIJSMM301BAXPO.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatacaaacgaactagtggctgcacc

SEQ ID NO: 539363 - DNA, 485 bp, Homo sapiens
  misc_feature: HIJSMM301A2RJ9.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggccaagctggagatcaaacgaactgtggctgcaccat

SEQ ID NO: 539364 - DNA, 502 bp, Homo sapiens
  misc_feature: HIJSMM301CJ5UH.48.36.D03.1.454.light.4.raw
agtatacatacacgaccggtgctcgatttagctgcgtcacgatctctcttggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcggggtcctgatcgcttctctggctccaagtctggcaacacggcctccctgaccatctctgggctccaggctgaagatcaggctgattattactgctgttcatttcaagttcctttttgtcttcggaactgggaccgaggtcaccgtcctaggtcagcccaaggccaaccccactgtcta

SEQ ID NO: 539365 - DNA, 484 bp, Homo sapiens; identical to SEQ ID NO: 535400
  misc_feature: HIJSMM301CVIIY.46.26.C04.1.454.light.4.raw

SEQ ID NO: 539366 - DNA, 494 bp, Homo sapiens; identical to SEQ ID NO: 534992
  misc_feature: HIJSMM301BD0LX.9.1.A01.1.454.light.4.raw

SEQ ID NO: 539367 - DNA, 506 bp, Homo sapiens
  misc_feature: HIJSMM301BW1YJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccaagggaccgaaggtggaaatcaaacgaacctgtggctgcaccatctgtcttcatcttccccg

SEQ ID NO: 539368 - DNA, 499 bp, Homo sapiens
  misc_feature: HIJSMM301BQQJJ.18.26.C04.1.454.light.4.raw
tacgagtatgcacgaccggtgctcgatttagtctagcgactttgggtttggggggtcgagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaagcccctaacctcctgatcaagggtccgtccagtttccagagtggggcctcaacaaggttcagcggcagtggatctgggacagatttcactctcaccatcaccagcccgcagcctgaagattttgcaacttactattgtcaacaggctgacaggttcccgctgactttcggcggagggaccaaggtagagatcaaaggaactgtggctgcaccatctgtcttcatcttcccgcc

SEQ ID NO: 539369 - DNA, 446 bp, Homo sapiens
  misc_feature: HIJSMM301BKTMB.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagagacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccaccctcctccatactcgta

SEQ ID NO: 539370 - DNA, 484 bp, Homo sapiens
  misc_feature: HIJSMM301DC5KB.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaaacgaactgtggctgcaccatct

SEQ ID NO: 539371 - DNA, 488 bp, Homo sapiens
  misc_feature: HIJSMM301A1KRD.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgcaatcttcagacatcagtggtacttatgtcttcggaactgggaccaaggtcaccgtcctaggtcagcccaaggccaaccccactgtcact

SEQ ID NO: 539372 - DNA, 518 bp, Homo sapiens
  misc_feature: HIJSMM301D4PUK.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttccccg

SEQ ID NO: 539373 - DNA, 477 bp, Homo sapiens
  misc_feature: HIJSMM301B3JNJ.9.76.G10.1.454.light.4.raw
tgatacgtctcacgaccggtgctcgatttagtcactcatacagggggggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctcccgggaaaggctcccaaactcctcatctattatgatgatctgctgccctcaggggtctctgaccgattctctggctccaagtctggcacctcagcctccctggccatcagtgggctccagtctgaggatgaggctgattattactgtggagcatgggatgacagcctgaatgcttggatgtcggcggagggaccaagctgaccgtctaggtcagcccaa

SEQ ID NO: 539374 - DNA, 493 bp, Homo sapiens
  misc_feature: HIJSMM301AV1SY.52.33.C11.1.454.light.4.raw
cgcagtacgacacgaccggtgctcgatttagagtgagctcgttgggtttgggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagcccggccaggcccctgtcttgcttatttataaagactttgagaggccctcagggacccctgagcgattctctggctccagctcagcgacaacagtcacgttgaccatcagtggagtccaggcagaggacgaggctgactattactgtcagtcatcagacagcagtggcacttatgtcgtattcggcggagggaccaaactgaccgtcctaggtcagcccaaggctgtccccccg

SEQ ID NO: 539375 - DNA, 493 bp, Homo sapiens
  misc_feature: HIJSMM301DK7ID.47.36.D03.1.454.light.4.raw
  modified_base (406)..(406): a, c, t, g, unknown or other
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgtagcctgaagattttggaacttnttattgtcaacagggtaacagtttcccgctcaccttcggcggagggaccaaggtggagatgaaaagaactgtggctgcaccatctgt

SEQ ID NO: 539376 - DNA, 472 bp, Homo sapiens
  misc_feature: HIJSMM301BZD88.7.81.H04.1.454.light.4.raw
  modified_base (447)..(447): a, c, t, g, unknown or other
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaaacctgatgattttgcaacttactactgtcaacagagttccactaccccaatcacttcgtccctcggcgtnaagtgcatatgaagaagaatagtgg

SEQ ID NO: 539377 - DNA, 499 bp, Homo sapiens
  misc_feature: HIJSMM301D9IZG.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatacaaacgaactgtggctgcaccta

SEQ ID NO: 539378 - DNA, 502 bp, Homo sapiens
  misc_feature: HIJSMM301AHV8U.10.86.H09.1.454.light.4.raw
catagtagtgcacgaccggtgctcgatttagtgctatagactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccgccctcctccactactatg

SEQ ID NO: 539379 - DNA, 444 bp, Homo sapiens; identical to SEQ ID NO: 535594
  misc_feature: HIJSMM301DM9VR.9.9.A09.1.454.light.4.raw

SEQ ID NO: 539380 - DNA, 506 bp, Homo sapiens
  misc_feature: HIJSMM301DQPGW.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccgaaagtaggatatcaaacgaactgtggctgcaccactctgt

SEQ ID NO: 539381 - DNA, 452 bp, Homo sapiens
  misc_feature: HIJSMM301A7A3E.13.23.C01.1.454.light.4.raw
tcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccgactgaccgtcctcggtcagcccaaggctgccccatcggtcactctgttcccaccctcctctagtacgtga

SEQ ID NO: 539382 - DNA, 513 bp, Homo sapiens
  misc_feature: HIJSMM301APVC5.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctcccggggtccctcgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctcgccccccg

SEQ ID NO: 539383 - DNA, 521 bp, Homo sapiens
  misc_feature: HIJSMM301AJGL8.43.81.H04.1.454.light.4.raw
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggacgtcagttgaccgtcctaggtcagcccaacggctgccccctccggtcacctctgttcccaccctcctcacta

SEQ ID NO: 539384 - DNA, 497 bp, Homo sapiens; identical to SEQ ID NO: 535664
  misc_feature: HIJSMM301BGLS8.22.14.B03.1.454.light.4.raw

SEQ ID NO: 539385 - DNA, 494 bp, Homo sapiens; identical to SEQ ID NO: 534992
  misc_feature: HIJSMM301BRKT1.9.1.A01.1.454.light.4.raw

SEQ ID NO: 539386 - DNA, 468 bp, Homo sapiens
  misc_feature: HIJSMM301BF1BL.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcacttcggccctggactgagtgcatatgaagagaactgtgg

SEQ ID NO: 539387 - DNA, 519 bp, Homo sapiens
  misc_feature: HIJSMM301EWN13.40.87.H10.1.454.light.4.raw
tctagcgactcacgaccggtgctcgatttagcagtactgcgttgggtttgggggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggagggaccaagctgaccgtcctaggtcagcccaaggctgccccctcggtcactctgttcccacctcctc

SEQ ID NO: 539388 - DNA, 471 bp, Homo sapiens
  misc_feature: HIJSMM301DRWIC.13.39.D06.1.454.light.4.raw
tcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcct

SEQ ID NO: 539389 - DNA, 498 bp, Homo sapiens; identical to SEQ ID NO: 535295
  misc_feature: HIJSMM301C7W90.15.25.C03.1.454.light.4.raw

SEQ ID NO: 539390 - DNA, 493 bp, Homo sapiens; identical to SEQ ID NO: 535084
  misc_feature: HIJSMM301BA03K.47.64.F09.1.454.light.4.raw

SEQ ID NO: 539391 - DNA, 505 bp, Homo sapiens
  misc_feature: HIJSMM301AHI5F.43.22.B11.1.454.light.4.raw
tgtgagtagtcacgaccggtgctcgatttagacgacagctcaggggtctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaataattttgtttcctggtaccagcaactcccaggaacagcccccaaactcctcatttatgacagtaataggcgaccctcagggattcctgaccgattctctggctccaagtctggcacgtcagccaccctgggcatcaccggactccagactggggacgaggccgattattactgcggaacatgggacagcagcctgaatacttgggtgttcggcggagggaccaggctgaccgtcctaagtcagcccaaggctgccccctc

SEQ ID NO: 539392 - DNA, 516 bp, Homo sapiens
  misc_feature: HIJSMM301A6MHX.12.85.H08.1.454.light.4.raw
atacgacgtacacgaccggtgctcgatttagtatcactcagtcgcgggggggtcgtcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtcctaagtcagcccaaggctgccccctggtcactctgttcccca

SEQ ID NO: 539393 - DNA, 481 bp, Homo sapiens; identical to SEQ ID NO: 535993
  misc_feature: HIJSMM301DUUNH.21.25.C03.1.454.light.4.raw

SEQ ID NO: 539394 - DNA, 493 bp, Homo sapiens
  misc_feature: HIJSMM301EFAQM.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtcttc

SEQ ID NO: 539395 - DNA, 489 bp, Homo sapiens
  misc_feature: HIJSMM301CZCTJ.46.26.C04.1.454.light.4.raw
actagcagtacacgaccggtgctcgatttagtctagcgactttgggtttgggtgatcaggactcctcagttcaccttctcacaatgaggctccctgctcagctcctggggctactaatgctctgggtctctggatccagtggggatattgtgatgactcagtctccactctccctgcccgtcacccctggagagccggcctccatctcctgcaggtctagtcggagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaactgtgg

SEQ ID NO: 539396 - DNA, 496 bp, Homo sapiens
  misc_feature: HIJSMM301A582O.51.39.D06.1.454.light.4.raw
cgatcgtatacacgaccggtgctcgatttagtgacatctcgcagttctttgggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcagggacactggtcacattgaccatcagtggagtccaggcagaagacgaggctgactatttctgtcaatcttcagacgtcagtggtacttatgtcttcggaactgggaccaaggtcaccgtcctaggtcagcccaaggccaaccccactgt

SEQ ID NO: 539397 - DNA, 489 bp, Homo sapiens
  misc_feature: HIJSMM301DQ6A4.14.55.E11.1.454.light.4.raw
cgtctagtaccacgaccggtgctcgatttagcactcgcacgttgggtttggggagtctcaatcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccaaggcggagatcagacgaactgtggctgcaccatctgtcttcta

SEQ ID NO: 539398 - DNA, 503 bp, Homo sapiens
  misc_feature: HIJSMM301DA8UX.15.25.C03.1.454.light.4.raw
tctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactatttggattggtacctgcagaagccagggcagtctccacaactcctgatctatttgggttctaatcgggcctccgggtccctgacaggttcagtggcagtggatcaggcatagattttacactgaaaatcagcagagtggaggctgaggacgttggggtttattactgcatgcaaggtctacaaaccccgatcaccttcggccgagggacacgcctggaggattaaacggaactgtggctgcaccatctgtt

SEQ ID NO: 539399 - DNA, 493 bp, Homo sapiens; identical to SEQ ID NO: 536769
  misc_feature: HIJSMM301B1NDF.19.83.H06.1.454.light.4.raw

SEQ ID NO: 539400 - DNA, 493 bp, Homo sapiens; identical to SEQ ID NO: 535047
  misc_feature: HIJSMM301B0GXE.16.53.E09.1.454.light.4.raw

SEQ ID NO: 539401 - DNA, 491 bp, Homo sapiens
  misc_feature: HIJSMM301CDAZ9.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcgtcggagggaccgaacgcggagatcagacgaactagtggctgcaccactctgtcttcta

SEQ ID NO: 539402 - DNA, 491 bp, Homo sapiens
  misc_feature: HIJSMM301AOZCL.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgtgg

SEQ ID NO: 539403 - DNA, 499 bp, Homo sapiens
  misc_feature: HIJSMM301AFU15.48.59.F04.1.454.light.4.raw
agtatacatacacgaccggtgctcgatttagtacacacacttagggattgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcat

SEQ ID NO: 539404 - DNA, 444 bp, Homo sapiens; identical to SEQ ID NO: 535192
  misc_feature: HIJSMM301AJYXD.5.9.A09.1.454.light.4.raw

SEQ ID NO: 539405 - DNA, 383 bp, Homo sapiens; identical to SEQ ID NO: 447524
  misc_feature: HIJSMM301B5LVH.41.26.C04.1.454.light.4.raw

SEQ ID NO: 539406 - DNA, 494 bp, Homo sapiens; identical to SEQ ID NO: 534992
  misc_feature: HIJSMM301BO6BQ.9.1.A01.1.454.light.4.raw

SEQ ID NO: 539407 - DNA, 483 bp, Homo sapiens
  misc_feature: HIJSMM301AN8B6.11.17.B06.1.454.light.4.raw
cgagagataccacgaccggtgctcgatttagtcgatagtgaagggggcgaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccgaaggtggaaatcaaacgaactagtggctgcacca

SEQ ID NO: 539408 - DNA, 494 bp, Homo sapiens; identical to SEQ ID NO: 534992
  misc_feature: HIJSMM301BIE3S.9.1.A01.1.454.light.4.raw

SEQ ID NO: 539409 - DNA, 486 bp, Homo sapiens; identical to SEQ ID NO: 536261
  misc_feature: HIJSMM301DC08H.26.55.E11.1.454.light.4.raw

SEQ ID NO: 539410 - DNA, 493 bp, Homo sapiens; identical to SEQ ID NO: 535084
  misc_feature: HIJSMM301AWC1D.47.64.F09.1.454.light.4.raw

SEQ ID NO: 539411 - DNA, 487 bp, Homo sapiens
  misc_feature: HIJSMM301CDSTS.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgtctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagcccaaggctcgccccccg

SEQ ID NO: 539412 - DNA, 507 bp, Homo sapiens; identical to SEQ ID NO: 535641
  misc_feature: HIJSMM301CNK4B.10.88.H11.1.454.light.4.raw

SEQ ID NO: 539413 - DNA, 493 bp, Homo sapiens; identical to SEQ ID NO: 539202
  misc_feature: HIJSMM301BLAL5.22.57.F02.1.454.light.4.raw

SEQ ID NO: 539414 - DNA, 504 bp, Homo sapiens
  misc_feature: HIJSMM301EESEX.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcgggcgggggaccgaaggtggagttcaaacgaactgtggctgcaccatctgtcttcatcttcccg

SEQ ID NO: 539415 - DNA, 486 bp, Homo sapiens; identical to SEQ ID NO: 535917
  misc_feature: HIJSMM301DJODE.3.10.A10.1.454.light.4.raw

SEQ ID NO: 539416 - DNA, 481 bp, Homo sapiens; identical to SEQ ID NO: 535993
  misc_feature: HIJSMM301ARJAB.21.25.C03.1.454.light.4.raw

SEQ ID NO: 539417 - DNA, 460 bp, Homo sapiens
  misc_feature: HIJSMM301EKQ28.43.66.F11.1.454.light.4.raw
tgtgagtagtcacgaccggtgctcgatttagtcacgcgagaaaggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgaactactcaca

SEQ ID NO: 539418 - DNA, 491 bp, Homo sapiens
  misc_feature: HIJSMM301ES1X8.49.42.D09.1.454.light.4.raw
agtcgagagacacgaccggtgctcgatttagacacatacgcagggaaagggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaaggcccccaaactcttcatttatgatgtcactaatcggccctcaggggtccctgatcgcttctctgcctccaagtctggcaacacggcctccctgaccatctctgggctccaggctgaggatgaggctcattattattgttgctcatatgcaggcaacttcgcttttgtcttcggaactgggaccgaggtcaccgtcctgggtcagcccaagg

SEQ ID NO: 539419 - DNA, 485 bp, Homo sapiens; identical to SEQ ID NO: 539315
  misc_feature: HIJSMM301D40IZ.3.88.H11.1.454.light.4.raw

SEQ ID NO: 539420 - DNA, 484 bp, Homo sapiens
  misc_feature: HIJSMM301EYLUR.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctcgtacgtaga

SEQ ID NO: 539421 - DNA, 507 bp, Homo sapiens; identical to SEQ ID NO: 535316
  misc_feature: HIJSMM301A1RJH.18.37.D04.1.454.light.4.raw

SEQ ID NO: 539422 - DNA, 441 bp, Homo sapiens; identical to SEQ ID NO: 534971
  misc_feature: HIJSMM301A5FV6.11.3.A03.1.454.light.4.raw

SEQ ID NO: 539423 - DNA, 485 bp, Homo sapiens
  misc_feature: HIJSMM301DBJEI.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtgctgcaccat

SEQ ID NO: 539424 - DNA, 490 bp, Homo sapiens
  misc_feature: HIJSMM301ANDQ8.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacactttggccggggaccaagctggaaatcaagcgaactgtggctgcaccatctgtcttcat

SEQ ID NO: 539425 - DNA, 498 bp, Homo sapiens
  misc_feature: HIJSMM301AOWS5.43.42.D09.1.454.light.4.raw
tgtgagtagtcacgaccggtgctcgatttagacacatacgcagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggcggagggaccaaggtggagatcaaacgaactgtggctgcaccatctgtcttcta

SEQ ID NO: 539426 - DNA, 499 bp, Homo sapiens
  misc_feature: HIJSMM301AU18D.16.12.B01.1.454.light.4.raw
tgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctcgtattggtcatctttcaagataccgagcggccctcagagatccctgagcgattctctggctccaactctgggaacacagccactctgaccatcagcggggcccagactatggatgaggctgactattactgtcaggcgtgggacagcaattctgtgattttcggcggagggaccaagttgaccgtcctaggtcagcccaaggctgccccctcggtcactcttccg

SEQ ID NO: 539427 - DNA, 496 bp, Homo sapiens
  misc_feature: HIJSMM301DUEBX.43.42.D09.1.454.light.4.raw
tgtgagtagtcacgaccggtgctcgatttagacacatacgcagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggcggagggaccaaggtggagatcaaacgaactgtggctgcaccatctgtcttcatt

SEQ ID NO: 539428 - DNA, 490 bp, Homo sapiens; identical to SEQ ID NO: 538866
  misc_feature: HIJSMM301A0RJ4.40.81.H04.1.454.light.4.raw

SEQ ID NO: 539429 - DNA, 471 bp, Homo sapiens
  misc_feature: HIJSMM301CPCNF.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacgttcggccaaggaccaaggtggaaatcaaacgaa

SEQ ID NO: 539430 - DNA, 513 bp, Homo sapiens
  misc_feature: HIJSMM301B9KO3.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccggggccactttcggcctcggaccgaaattagtagagtcaaacgaactagtggcgtgcaccatctgtcttctactcttcccgtccact

SEQ ID NO: 539431 - DNA, 514 bp, Homo sapiens
  misc_feature: HIJSMM301C3F5G.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcagggtcagcccaaggccaacccactgtcact

SEQ ID NO: 539432 - DNA, 496 bp, Homo sapiens; identical to SEQ ID NO: 537225
  misc_feature: HIJSMM301D2MYG.11.59.F04.1.454.light.4.raw

SEQ ID NO: 539433 - DNA, 505 bp, Homo sapiens
  misc_feature: HIJSMM301B8SOE.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtctac

SEQ ID NO: 539434 - DNA, 506 bp, Homo sapiens
  misc_feature: HIJSMM301AKHZJ.48.71.G05.1.454.light.4.raw
agtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttcccg

SEQ ID NO: 539435 - DNA, 480 bp, Homo sapiens; identical to SEQ ID NO: 535975
  misc_feature: HIJSMM301BWJDG.51.60.F05.1.454.light.4.raw

SEQ ID NO: 539436 - DNA, 512 bp, Homo sapiens
  misc_feature: HIJSMM301CJYSY.41.53.E09.1.454.light.4.raw
tctatactatcacgaccggtgctcgatttagagagagtgtgttgggtttggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggtttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgtt

SEQ ID NO: 539437 - DNA, 495 bp, Homo sapiens
  misc_feature: HIJSMM301DI9IW.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagttattactgtcagcagcgtaccaagtggcctccgacttttggccaggggccaagctggagatcagacgaactgtggctgcaccatctgtcttcatcttccccg

SEQ ID NO: 539438 - DNA, 444 bp, Homo sapiens
  misc_feature: HIJSMM301CLO9J.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggacctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgacacgcgag

SEQ ID NO: 539439 - DNA, 493 bp, Homo sapiens
  misc_feature: HIJSMM301ALQV1.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagtagactggagcctgaggattttgcagtgtattactgtcagcagtatcataggtcaaacaccttcggccaagggacacgactggagattaaaggaactgtggctgcaccatctgtcttcatcttcccg

SEQ ID NO: 539440 - DNA, 487 bp, Homo sapiens
  misc_feature: HIJSMM301DEVD6.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctgcccccc

SEQ ID NO: 539441 - DNA, 478 bp, Homo sapiens; identical to SEQ ID NO: 535129
  misc_feature: HIJSMM301AX4HE.11.11.A11.1.454.light.4.raw

SEQ ID NO: 539442 - DNA, 487 bp, Homo sapiens
  misc_feature: HIJSMM301DT2K5.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatggtggcagtttattattgtcaacaatattattatacttcgtggacgttcggccaagggaccaaggtggatatcagacgaa

SEQ ID NO: 539443 - DNA, 496 bp, Homo sapiens
  misc_feature: HIJSMM301CW76Y.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcactctgttctcaccctcctcgagtagtaca

SEQ ID NO: 539444 - DNA, 485 bp, Homo sapiens
  misc_feature: HIJSMM301EYBMW.46.26.C04.1.454.light.4.raw
  modified_base (378)..(378): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttactacngaaaatacagcagagtggaggctgaggatgttgggctctattattgcatgcaagctctacaagtcccgctcactttcggcggaggaccaaggtggagatacaacgaa

SEQ ID NO: 539445 - DNA, 499 bp, Homo sapiens
  misc_feature: HIJSMM301CH39H.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccgggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccggggaccaagctggaaatcaagcgaactgtggctgcaccatctgtcttcatcttccccg

SEQ ID NO: 539446 - DNA, 443 bp, Homo sapiens
  misc_feature: HIJSMM301CO2VL.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctggtcactctgttcccaccctcctccactactatg

SEQ ID NO: 539447 - DNA, 447 bp, Homo sapiens
  misc_feature: HIJSMM301D7ZMJ.18.9.A09.1.454.light.4.raw
  modified_base (422)..(422): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactcngttcccgccctcctccatactcgta

SEQ ID NO: 539448 - DNA, 497 bp, Homo sapiens; identical to SEQ ID NO: 535740
  misc_feature: HIJSMM301A66TB.3.71.G05.1.454.light.4.raw

SEQ ID NO: 539449 - DNA, 475 bp, Homo sapiens
  misc_feature: HIJSMM301B85LJ.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaattagttcaccttaaggaacagccaagcgctagccagttaagtgaggcatctcaattgcaaggttttctctgcatcggtcaggttagtgatattaacagcgaaaagagtatttttgtaaggggaaagtaatgaagttaacactgtggatcaccttcggccaagggacacgactggagattaaacgaactgtggctgcaccatctgtcttcatcttcccgccatctgaagtatgtct

SEQ ID NO: 539450 - DNA, 503 bp, Homo sapiens
  misc_feature: HIJSMM301A4Q6S.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaaactgtggctgcaccatctgtcttctatcttcccgccca

SEQ ID NO: 539451 - DNA, 484 bp, Homo sapiens
  misc_feature: HIJSMM301D8M0H.49.29.C07.1.454.light.4.raw
agtcgagagacacgaccggtgctcgatttagagtgctacgaagggaaagggggatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgttgggatttattactgcatgcaagctctacaagctcctcagctcactttcggcgagggaccaaggtggagatcaaacgaa

SEQ ID NO: 539452 - DNA, 500 bp, Homo sapiens
  misc_feature: HIJSMM301EY11B.48.41.D08.1.454.light.4.raw
agtatacatacacgaccggtgctcgatttagtcacgcgagaaagggaaaggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttc

SEQ ID NO: 539453 - DNA, 493 bp, Homo sapiens; identical to SEQ ID NO: 535047
  misc_feature: HIJSMM301AU2OU.16.53.E09.1.454.light.4.raw

SEQ ID NO: 539454 - DNA, 495 bp, Homo sapiens; identical to SEQ ID NO: 536055
  misc_feature: HIJSMM301D7BZA.47.38.D05.1.454.light.4.raw

SEQ ID NO: 539455 - DNA, 504 bp, Homo sapiens
  misc_feature: HIJSMM301BABCP.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacaacaaaatacagcctctctgaccattactggtctccagcctgacgacgaggctgactactactgctcagcctgggacaccagcctcgctgcttggctttcggcggaggaccaagctgaccgtcctggtcagccaaggctcgcccctcggtctacc

SEQ ID NO: 539456 - DNA, 493 bp, Homo sapiens
  misc_feature: HIJSMM301DR5R7.10.79.H02.1.454.light.4.raw
catagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtctt

SEQ ID NO: 539457 - DNA, 493 bp, Homo sapiens; identical to SEQ ID NO: 537281
  misc_feature: HIJSMM301CQTDN.9.1.A01.1.454.light.4.raw

SEQ ID NO: 539458 - DNA, 489 bp, Homo sapiens
  misc_feature: HIJSMM301CXN7G.22.25.C03.1.454.light.4.raw
acatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaactggtgtcccatcaaggttcagcggcagtggatctgggacagaattcactctcgccatcagcagcctgcagcctgatgattctgcaacttattactgccaacagtattatagttatcgggggacgttcggccaagggaccaaggtggaaatcaaacgaactgtggctgcaccatct

SEQ ID NO: 539459 - DNA, 508 bp, Homo sapiens
  misc_feature: HIJSMM301EQTW0.10.71.G05.1.454.light.4.raw
catagtagtgcacgaccggtgctcgatttagtgtcgtcgcaagagagaggggggaacgtgctcagttaggacccagagggaaccatggaagccccacgctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaatagaggtcaaacgaactgtggctgcaccatctgtcttcatcttccccg

SEQ ID NO: 539460 - DNA, 444 bp, Homo sapiens; identical to SEQ ID NO: 535027
  misc_feature: HIJSMM301EN2J4.8.73.G07.1.454.light.4.raw

SEQ ID NO: 539461 - DNA, 485 bp, Homo sapiens; identical to SEQ ID NO: 536576
  misc_feature: HIJSMM301APNWX.46.35.D02.1.454.light.4.raw

SEQ ID NO: 539462 - DNA, 496 bp, Homo sapiens
  misc_feature: HIJSMM301CS1OD.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatccccagccaggttcagtggcagtgggtctgggacagacttcactctcaccatcagcagcctagagcctgaagattttgcagtttattactgtcagcagcgtagcaactccctcacgttcggcggagggaccaaggtggagatacaaacgaactgtggctgcaccatctgtctcatcttcccgcc

SEQ ID NO: 539463 - DNA, 503 bp, Homo sapiens
  misc_feature: HIJSMM301CCOV8.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctaggtcagcccaaggctgccccctcggt

SEQ ID NO: 539464 - DNA, 489 bp, Homo sapiens
  misc_feature: HIJSMM301DHXYD.51.83.H06.1.454.light.4.raw
cgatcgtatacacgaccggtgctcgatttagatcacgtgcgtcgcggggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctgcagtctgaagattttgcaatttattactgtcagcagtatataactggcctccgtacacttttggccaggggaccaagctggagatcaaacgaactgtggctgcaccatctgt

SEQ ID NO: 539465 - DNA, 416 bp, Homo sapiens; identical to SEQ ID NO: 536892
  misc_feature: HIJSMM301BUTD1.16.46.E02.1.454.light.4.raw

SEQ ID NO: 539466 - DNA, 507 bp, Homo sapiens
  misc_feature: HIJSMM301AZJCI.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaactgtggctgcaccatctgtcttcta

SEQ ID NO: 539467 - DNA, 476 bp, Homo sapiens
  misc_feature: HIJSMM301C2NP8.48.5.A05.1.454.light.4.raw
agtatacatacacgaccggtgctcgatttagatagatagacagggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccaaggtggaaatcaaacgaactgtgctgcaccat

SEQ ID NO: 539468 - DNA, 511 bp, Homo sapiens
  misc_feature: HIJSMM301ETVQA.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagtttaatagtgatcatccggggtattcggcggagggaccaaggtgaccgtcctacgtcagcccaaggctgccccctcggtcactctgttcccaccctcct

SEQ ID NO: 539469 - DNA, 479 bp, Homo sapiens; identical to SEQ ID NO: 535665
  misc_feature: HIJSMM301BLAGM.12.10.A10.1.454.light.4.raw

SEQ ID NO: 539470 - DNA, 521 bp, Homo sapiens
  misc_feature: HIJSMM301EJELD.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 539471 - DNA, 487 bp, Homo sapiens; identical to SEQ ID NO: 538190
  misc_feature: HIJSMM301B3J1Y.47.70.G04.1.454.light.4.raw

SEQ ID NO: 539472 - DNA, 502 bp, Homo sapiens
  misc_feature: HIJSMM301BAFKF.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgacaccatctgtctt

SEQ ID NO: 539473 - DNA, 489 bp, Homo sapiens; identical to SEQ ID NO: 537328
  misc_feature: HIJSMM301AEC1E.13.5.A05.1.454.light.4.raw

SEQ ID NO: 539474 - DNA, 510 bp, Homo sapiens
  misc_feature: HIJSMM301APR6E.2.21.B10.1.454.light.4.raw
acgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacgagaagtggtaattacatggtgttcggcggagggaccaagctgaccgtcctacgtcagcccaaggctgccccctcggtcactctcg

SEQ ID NO: 539475 - DNA, 495 bp, Homo sapiens; identical to SEQ ID NO: 536055
  misc_feature: HIJSMM301AVA0O.47.38.D05.1.454.light.4.raw

SEQ ID NO: 539476 - DNA, 502 bp, Homo sapiens; identical to SEQ ID NO: 536253
  misc_feature: HIJSMM301DCRBT.21.22.B11.1.454.light.4.raw

SEQ ID NO: 539477 - DNA, 496 bp, Homo sapiens; identical to SEQ ID NO: 537925
  misc_feature: HIJSMM301CYSEJ.22.14.B03.1.454.light.4.raw

SEQ ID NO: 539478 - DNA, 475 bp, Homo sapiens
  misc_feature: HIJSMM301ES8LV.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcacttcggccctgggactgaagtgcatatgaagagaactgtggctgca

SEQ ID NO: 539479 - DNA, 520 bp, Homo sapiens
  misc_feature: HIJSMM301DIVVS.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccagggctgaccgtcctaggtcagcccaaggctgccccctcggtcactctgttcccgcct

SEQ ID NO: 539480 - DNA, 492 bp, Homo sapiens
  misc_feature: HIJSMM301A5M5F.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaaggaccaaacgtaggacatcaagcgaactgtggctgcaccatctgtt

SEQ ID NO: 539481 - DNA, 502 bp, Homo sapiens
  misc_feature: HIJSMM301DE6SS.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaaatgggaccaaggtcaccgtcctaggtcagcccaaggccaacccactgtca

SEQ ID NO: 539482 - DNA, 495 bp, Homo sapiens; identical to SEQ ID NO: 535821
  misc_feature: HIJSMM301DN1HA.3.31.C09.1.454.light.4.raw

SEQ ID NO: 539483 - DNA, 515 bp, Homo sapiens
  misc_feature: HIJSMM301B6N1M.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcct

SEQ ID NO: 539484 - DNA, 484 bp, Homo sapiens; identical to SEQ ID NO: 535240
  misc_feature: HIJSMM301AW11C.47.60.F05.1.454.light.4.raw

SEQ ID NO: 539485 - DNA, 490 bp, Homo sapiens; identical to SEQ ID NO: 536909
  misc_feature: HIJSMM301ESV72.12.27.C05.1.454.light.4.raw

SEQ ID NO: 539486 - DNA, 489 bp, Homo sapiens
  misc_feature: HIJSMM301CS4KZ.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactcgggacccacgttaccgtcctaggtcagaccccg

SEQ ID NO: 539487 - DNA, 482 bp, Homo sapiens
  misc_feature: HIJSMM301A2A25.10.3.A03.1.454.light.4.raw
catagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggcctggtatcagaagaaaccagggaaagccccgaaactcctgatccatactgcctccactttggcaagtggggtcccatcaaggttcagcggcagtggagctgggacagagttcactctcagtatcagcagcctgcagcctgatgattttgcaacctattattgtcaacaatatgacacttatccattctctttcggccctgggaccaaagtggattccaacgaactgtggctgcaccatctgtcttcatcttcccgccatctgacactacta

SEQ ID NO: 539488 - DNA, 354 bp, Homo sapiens; identical to SEQ ID NO: 535026
  misc_feature: HIJSMM301BAMKF.19.22.B11.1.454.light.4.raw

SEQ ID NO: 539489 - DNA, 495 bp, Homo sapiens
  misc_feature: HIJSMM301BZ1LX.51.59.F04.1.454.light.4.raw
cgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgt

SEQ ID NO: 539490 - DNA, 515 bp, Homo sapiens
  misc_feature: HIJSMM301ADQWK.15.86.H09.1.454.light.4.raw
  modified_base (497)..(497): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtcctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccnccctcctcgctacgtaga

SEQ ID NO: 539491 - DNA, 446 bp, Homo sapiens
  misc_feature: HIJSMM301DH35H.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccacctcctccatactcgta

SEQ ID NO: 539492 - DNA, 464 bp, Homo sapiens
  misc_feature: HIJSMM301DQP8Q.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccaccctcctccatactcgta

SEQ ID NO: 539493 - DNA, 517 bp, Homo sapiens
  misc_feature: HIJSMM301AVQHA.41.18.B07.1.454.light.4.raw
  modified_base (455)..(455): a, c, t, g, unknown or other
tctatactatcacgaccggtgctcgatttagtcgctgcgtaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaaacgnttgaccgtcccttaggtcacgcccaaacggacgttcgccccctcccggttcgaactcttccg

SEQ ID NO: 539494 - DNA, 515 bp, Homo sapiens; identical to SEQ ID NO: 538805
  misc_feature: HIJSMM301BUSCW.14.19.B08.1.454.light.4.raw

SEQ ID NO: 539495 - DNA, 495 bp, Homo sapiens
  misc_feature: HIJSMM301BW7CP.40.12.B01.1.454.light.4.raw
tctagcgactcacgaccggtgctcgatttagtagtgtagattccgcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatacctactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgcacca

SEQ ID NO: 539496 - DNA, 486 bp, Homo sapiens; identical to SEQ ID NO: 535043
  misc_feature: HIJSMM301BGD15.46.35.D02.1.454.light.4.raw

SEQ ID NO: 539497 - DNA, 494 bp, Homo sapiens
  misc_feature: HIJSMM301AU58S.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcggtccaagggaccgaaggtggaaagtacaaacgaactacgtggcgtgcaccact

SEQ ID NO: 539498 - DNA, 494 bp, Homo sapiens; identical to SEQ ID NO: 536444
  misc_feature: HIJSMM301BAU4V.26.72.G06.1.454.light.4.raw

SEQ ID NO: 539499 - DNA, 490 bp, Homo sapiens; identical to SEQ ID NO: 538714
  misc_feature: HIJSMM301ASZ8F.11.12.B01.1.454.light.4.raw

SEQ ID NO: 539500 - DNA, 518 bp, Homo sapiens; identical to SEQ ID NO: 539372
  misc_feature: HIJSMM301BBFLK.7.86.H09.1.454.light.4.raw

SEQ ID NO: 539501 - DNA, 493 bp, Homo sapiens
  misc_feature: HIJSMM301BZ3R8.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 539502 - DNA, 496 bp, Homo sapiens; identical to SEQ ID NO: 535423
  misc_feature: HIJSMM301AIRIC.3.33.C11.1.454.light.4.raw

SEQ ID NO: 539503 - DNA, 454 bp, Homo sapiens; identical to SEQ ID NO: 536347
  misc_feature: HIJSMM301COFIF.19.86.H09.1.454.light.4.raw

SEQ ID NO: 539504 - DNA, 497 bp, Homo sapiens
  misc_feature: HIJSMM301AJEL3.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagattttcacactgaaaatcagccggggtggggcgtgaggatgttggcatttatttactgcatgcaggctattacaccttcctgccacttttggtccgaggggaccgaagctggtagatacaggcgaacg

SEQ ID NO: 539505 - DNA, 486 bp, Homo sapiens
  misc_feature: HIJSMM301EXA5E.10.2.A02.1.454.light.4.raw
catagtagtgcacgaccggtgctcgatttagactcatctacaggggaggaactgctcacttaggacccagacggaaccatggaagccccacgcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagattttgcagtttattactgtcagcagtataatagctggcccgcgacgttcggccaagggaccgaggtggaattcaaacgaactgtggctgcaccatctgtctt

SEQ ID NO: 539506 - DNA, 481 bp, Homo sapiens
  misc_feature: HIJSMM301CM6SO.40.23.C01.1.454.light.4.raw
tctagcgactcacgaccggtgctcgatttagtacacgtgattagggattggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaaggccg

SEQ ID NO: 539507 - DNA, 493 bp, Homo sapiens
  misc_feature: HIJSMM301BA0AL.41.59.F04.1.454.light.4.raw
tctatactatcacgaccggtgctcgatttagtacacacacttagggattgggggagtcagacccagtcaggacacagcatggacatgagggtccccgctcagctcctggggctcctgctgctctggttcccaggttcccgatgcggcatccagatgacccagtctccatctttcgtgtctgcatctataggagacagagtcaccatcacttgtcgggcgagtcaggatattaggacgtggttagcctggtatcgacagagaccgggaagagcccctgaactcctcgtctatgatgcatccactttacatcgtggggtcccatcacggttcagcggcagtggatctgggacagacttcagtctcaccatcagtaccctgcagcctgacgattttgcaatttatttttgtcaacaggctaataggttccctcaaacattcggccctgggaccagagtggatttgaagcgaactgtggctgcaccatctgtcttca

SEQ ID NO: 539508 - DNA, 483 bp, Homo sapiens
  misc_feature: HIJSMM301D79FJ.46.26.C04.1.454.light.4.raw
actagcagtacacgaccggtgctcgatttagtctagcgactttgggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtgacagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 539509 - DNA, 495 bp, Homo sapiens
  misc_feature: HIJSMM301BLUKN.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggccaggggacccaggtggaggatcagacgaactgtggctgcaccatctgtcttcatcttcccg

SEQ ID NO: 539510 - DNA, 497 bp, Homo sapiens; identical to SEQ ID NO: 536371
  misc_feature: HIJSMM301DD8IM.16.78.H01.1.454.light.4.raw

SEQ ID NO: 539511 - DNA, 485 bp, Homo sapiens
  misc_feature: HIJSMM301BWWEI.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 539512 - DNA, 476 bp, Homo sapiens
  misc_feature: HIJSMM301C7N88.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtggggtcccatcaaggttcagtggcagtggatctgggacagatttcactctcaccatccgcagtctgcaacctgaagatttgcaatttattactgtcaagagactcacaatggaggcacttttggccaggggaccaagctggagaggaaacgaactgtggctgcaccat

SEQ ID NO: 539513 - DNA, 454 bp, Homo sapiens; identical to SEQ ID NO: 534964
  misc_feature: HIJSMM301D84QU.19.86.H09.1.454.light.4.raw

SEQ ID NO: 539514 - DNA, 490 bp, Homo sapiens; identical to SEQ ID NO: 535526
  misc_feature: HIJSMM301APPK1.26.78.H01.1.454.light.4.raw

SEQ ID NO: 539515 - DNA, 490 bp, Homo sapiens
  misc_feature: HIJSMM301DAXO0.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtgaggtcaaacgaactgtggctgcaccatctgtcttcatt

SEQ ID NO: 539516 - DNA, 490 bp, Homo sapiens
  misc_feature: HIJSMM301AOC0S.9.19.B08.1.454.light.4.raw
tgatacgtctcacgaccggtgctcgatttagtgagtcagtaagggggcttcgagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcgggcaggttatgatgtccactggtaccagcagtttccaggaacagtccccagggtcctcatctttggttacagtaatcggccctcaggggtccctgaccgattctctggctccaagtctgacacctcagcctccctggccatcactgggctccagactgaggatgaggctcattattactgccagtcttatgacaaacgtcagaacatttgggtgttcggcggagggaccaagctgaccgtctcagtcagccc

SEQ ID NO: 539517 - DNA, 499 bp, Homo sapiens
  misc_feature: HIJSMM301EVCV6.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccccgtccctcctaccgacgagtacgtacgtagcgggccggtcggtcggacgacggccgactagag

SEQ ID NO: 539518 - DNA, 478 bp, Homo sapiens; identical to SEQ ID NO: 535129
  misc_feature: HIJSMM301DXRE1.11.11.A11.1.454.light.4.raw

SEQ ID NO: 539519 - DNA, 486 bp, Homo sapiens; identical to SEQ ID NO: 536323
  misc_feature: HIJSMM301B5WLG.10.2.A02.1.454.light.4.raw

SEQ ID NO: 539520 - DNA, 514 bp, Homo sapiens
  misc_feature: HIJSMM301AUX8T.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctcgttccccta

SEQ ID NO: 539521 - DNA, 460 bp, Homo sapiens; identical to SEQ ID NO: 536053
  misc_feature: HIJSMM301C60Z8.22.28.C06.1.454.light.4.raw

SEQ ID NO: 539522 - DNA, 503 bp, Homo sapiens
  misc_feature: HIJSMM301AG63T.48.32.C10.1.454.light.4.raw
agtatacatacacgaccggtgctcgatttagtatagacatcaacacacaaagggcacgaccggtgctcgatttagtatagacatcaacacacaaaggggagagctgctcagttaggacccacgagggaaccgatggaaaccccacgcgcagcttctcttcctcctgctactctggctcccagataccaccggagaaattgtgttgacgcagtctccaggcaccctgtctttgtctccaggggaagagccaccctctcctgcagggccagtgagacagttactgttaattatttggcctggtaccagcagaagcctggccaggctcccaggctcctcatctctgctgcatcctacagggccactggcatccccagacaggttcagtggcagtgggtctgggacagacttcactctctccatcagcagactggagcctgaagattttgcaatttattactgtcaccagtatggtagctcacctctaactttcggcggagggaccg

SEQ ID NO: 539523 - DNA, 509 bp, Homo sapiens; identical to SEQ ID NO: 539269
  misc_feature: HIJSMM301BJS8Z.4.57.F02.1.454.light.4.raw

SEQ ID NO: 539524 - DNA, 499 bp, Homo sapiens
  misc_feature: HIJSMM301BQ53U.43.15.B04.1.454.light.4.raw
tgtgagtagtcacgaccggtgctcgatttagacagtatatatccgcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaaggggacttcggcaggaccaaggtggattcaaccgaactgtggctgcaccatctgtcttcatcttccg

SEQ ID NO: 539525 - DNA, 493 bp, Homo sapiens; identical to SEQ ID NO: 535047
  misc_feature: HIJSMM301BRV24.16.53.E09.1.454.light.4.raw

SEQ ID NO: 539526 - DNA, 441 bp, Homo sapiens; identical to SEQ ID NO: 535074
  misc_feature: HIJSMM301CQLKZ.11.3.A03.1.454.light.4.raw

SEQ ID NO: 539527 - DNA, 463 bp, Homo sapiens
  misc_feature: HIJSMM301COSI4.4.29.C07.1.454.light.4.raw
agcactgtagcacgaccggtgctcgatttagagtgctacgaagggaaagggggaagagctgctcagttaggacccagagggaaccatggaaaccccagcgcagcttctcttcctcctgctactctggctccctggggaaagagccaccctctcctgcagggccagtcagaatgttagcagcagattcttagcctggtatcagcagagacgtggccaggctcccaggctcatcatctatggtgcatccagcagggccactggcatcccagacaggttcagtggcagtgggtctgggacagacttcactctcaccatcagcgacctggagcctgaagattttgcagtgtattactgtcagcagtatggtagcgcacggacgttcgaccaaggggccagggtggaaatcaaacgaactgtggctgcaccatctgtcttcatcttcccgccatctgactacagtgct

SEQ ID NO: 539528 - DNA, 524 bp, Homo sapiens
  misc_feature: HIJSMM301B0ZES.49.9.A09.1.454.light.4.raw
agtcgagagacacgaccggtgctcgatttagcgagacgcgcaggggagtctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggccaccctgaccgtcagcagggtcgaagccggggatgaggccgactatatctgtcaggtgtgggatagtagtagtgctcttccgggggtgttcggcggagggaccaagttgaccgtcgttggtcagcccaaggctgccccctcggtcactctgttcccaccctcctctctctcg

SEQ ID NO: 539529 - DNA, 496 bp, Homo sapiens; identical to SEQ ID NO: 537513
  misc_feature: HIJSMM301BAEZC.12.87.H10.1.454.light.4.raw

SEQ ID NO: 539530 - DNA, 496 bp, Homo sapiens
  misc_feature: HIJSMM301CKZ28.43.28.C06.1.454.light.4.raw
tgtgagtagtcacgaccggtgctcgatttagagctcacgtattgggtttgggggatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtactggaggcacctacttgagttggtttcaccagaggccaggccaatctccaaggcgtctgatttataagatttctatccgggactctggggtcccagacaggttcagcggcagtgggtcagacactgacttcacactgagaatcagcagggtggaggctgaggatgttggaatttattactgcatgcaatcttcacactggcctccgtacacttttggccaggggaccaagctggagatcaacgaactgtggctgca

SEQ ID NO: 539531 - DNA, 500 bp, Homo sapiens
  misc_feature: HIJSMM301EAHKZ.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaatttcccgctcactttcggcggagggccaaggtggagatcaaacgaactgtggctgcaccatctgcttcatcttccccg

SEQ ID NO: 539532 - DNA, 485 bp, Homo sapiens
  misc_feature: HIJSMM301CT0RS.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcaggtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 539533 - DNA, 492 bp, Homo sapiens; identical to SEQ ID NO: 536901
  misc_feature: HIJSMM301B9PFJ.9.34.D01.1.454.light.4.raw
